US009701966B2

(12) United States Patent
Brown et al.

(10) Patent No.: US 9,701,966 B2
(45) Date of Patent: Jul. 11, 2017

(54) METHODS AND COMPOSITIONS FOR THE SPECIFIC INHIBITION OF GLYCOLATE OXIDASE (HAO1) BY DOUBLE-STRANDED RNA

(71) Applicant: Dicerna Pharmaceuticals, Inc., Cambridge, MA (US)

(72) Inventors: Bob D. Brown, Millington, NJ (US); Henryk T. Dudek, Wellesley, MA (US)

(73) Assignee: Dicerna Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 14/583,200

(22) Filed: Dec. 26, 2014

(65) Prior Publication Data

US 2015/0184160 A1 Jul. 2, 2015

Related U.S. Application Data

(60) Provisional application No. 61/937,838, filed on Feb. 10, 2014, provisional application No. 61/921,181, filed on Dec. 27, 2013.

(51) Int. Cl.
*C12N 15/113* (2010.01)
*A61K 48/00* (2006.01)

(52) U.S. Cl.
CPC ...... *C12N 15/1137* (2013.01); *C12N 2310/11* (2013.01); *C12N 2310/14* (2013.01); *C12Y 101/03015* (2013.01)

(58) Field of Classification Search
USPC .......... 435/6.1, 6.11, 91.1, 91.31, 6.12, 6.13, 435/375, 455, 458; 536/23.1, 24.5; 514/44
See application file for complete search history.

(56) References Cited

U.S. PATENT DOCUMENTS 8,084,599 B2 12/2011 Rossi et al.
8,349,809 B2 1/2013 Brown
8,513,207 B2 8/2013 Brown
2005/0277610 A1 12/2005 Rossi et al.
2007/0265220 A1 11/2007 Rossi et al.
2010/0144851 A1* 6/2010 McSwiggen ....... C12N 15/1136 514/44 R
2010/0298161 A1 11/2010 Hu et al.
2011/0178283 A1* 7/2011 Rigoutsos ............... G06F 19/22 536/24.5

OTHER PUBLICATIONS

Brzica, Hrvoje et al., "Oxalate: From the Environment to Kidney Stones," Arh Hig Rada Toksikol, vol. 64:609-630 (2013).
GenBank Accession No. NM_017545.2, 4 pages, Mar. 15, 2015.
Recalcati, Stefania et al., "Oxidative Stress-Mediated Down-Regulation of Rat Hydroxyacid Oxidase 1, a Liver-Specific Peroxisomal Enzyme," Hepatology, vol. 38:1159-1166 (2003).
Cochat et al., Epidemiology of primary hyperoxaluria type 1. Société de Néphrologie and the Société de Néphrologie Pédiatrique. Nephrol Dial Transplant. 1995;10 Suppl 8:3-7.
Cochat et al., Primary hyperoxaluria Type 1: indications for screening and guidance for diagnosis and; treatment. Nephrol Dial Transplant. May 2012;27(5):1729-36.
Cochat et al., Primary hyperoxaluria. N Engl J Med. Aug. 15, 2013;369(7):649-58.
Harambat et al., Characteristics and outcomes of children with primary oxalosis requiring renal replacement therapy. Clin J Am Soc Nephrol. Mar. 2012;7(3):458-65.
Kamoun et al., End-stage renal disease of the Tunisian child: epidemiology, etiologies, and outcome. Pediatr Nephrol. Aug. 1996;10(4):479-82.
van Woerden et al., Primary hyperoxaluria type 1 in The Netherlands: prevalence and outcome. Nephrol Dial Transplant. Feb. 2003;18(2):273-9.

* cited by examiner

*Primary Examiner* — Jane Zara
(74) *Attorney, Agent, or Firm* — Wolf, Greenfield & Sacks, P.C.

(57) ABSTRACT

This invention relates to compounds, compositions, and methods useful for reducing Glycolate Oxidase (HAO1) target RNA and protein levels via use of dsRNAs, e.g., Dicer substrate siRNA (DsiRNA) agents.

68 Claims, 77 Drawing Sheets

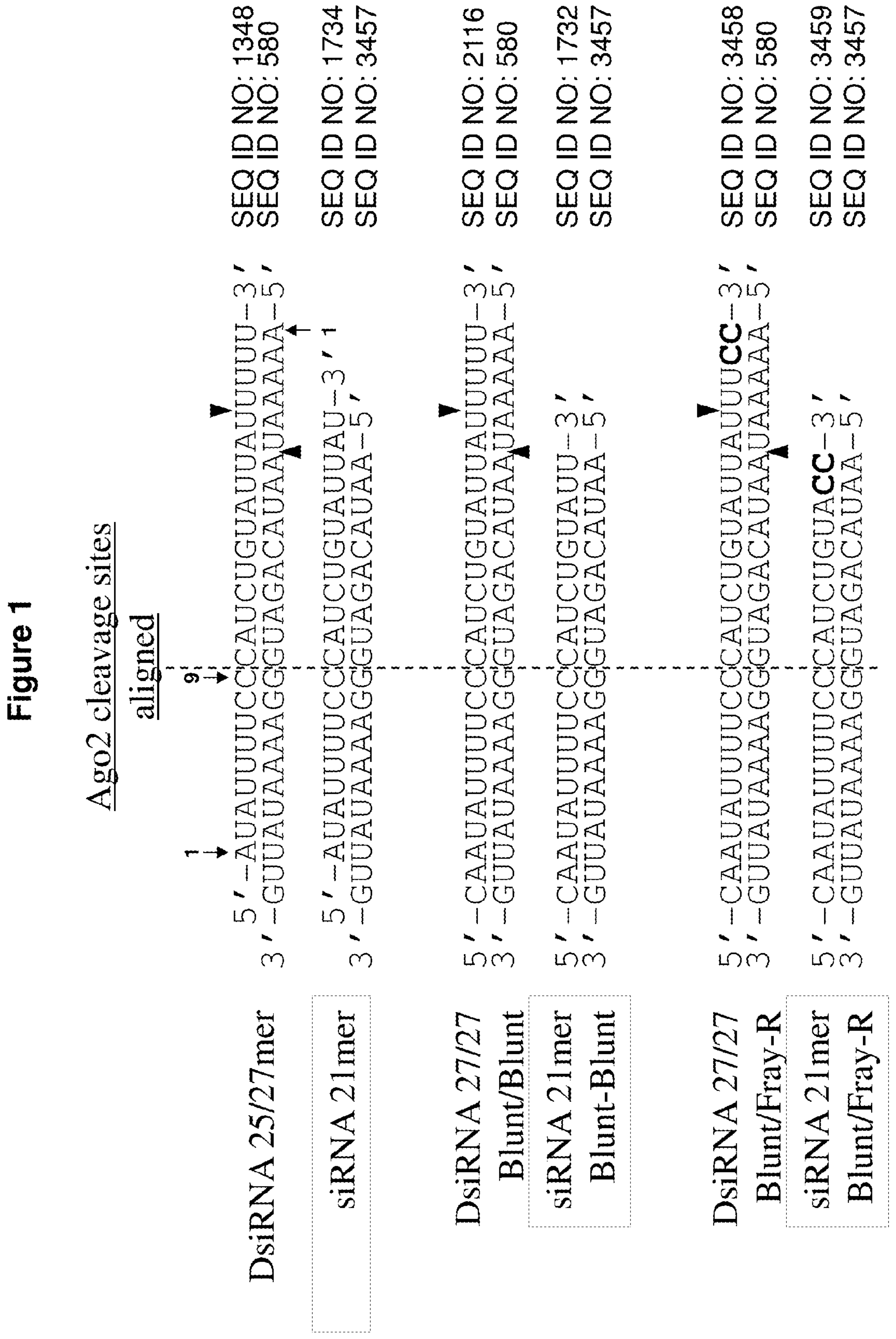
Figure 1
Ago2 cleavage sites aligned
1
9
1
DsiRNA 25/27mer
5'-AUAUUUUCCCAUCUGUAUUAUUUUU-3' SEQ ID NO: 1348
3'-GUUAUAAAAGGGUAGACAUAAUAAAAA-5' SEQ ID NO: 580
siRNA 21mer
5'-AUAUUUUCCCAUCUGUAUUAU-3' SEQ ID NO: 1734
3'-GUUAUAAAAGGGUAGACAUAA-5' SEQ ID NO: 3457
DsiRNA 27/27 Blunt/Blunt
5'-CAAUAUUUUCCCAUCUGUAUUAUUUUU-3' SEQ ID NO: 2116
3'-GUUAUAAAAGGGUAGACAUAAUAAAAA-5' SEQ ID NO: 580
siRNA 21mer Blunt-Blunt
5'-CAAUAUUUUCCCAUCUGUAUU-3' SEQ ID NO: 1732
3'-GUUAUAAAAGGGUAGACAUAA-5' SEQ ID NO: 3457
DsiRNA 27/27 Blunt/Fray-R
5'-CAAUAUUUUCCCAUCUGUAUUAUUUCC-3' SEQ ID NO: 3458
3'-GUUAUAAAAGGGUAGACAUAAUAAAAA-5' SEQ ID NO: 580
siRNA 21mer Blunt/Fray-R
5'-CAAUAUUUUCCCAUCUGUACC-3' SEQ ID NO: 3459
3'-GUUAUAAAAGGGUAGACAUAA-5' SEQ ID NO: 3457

Hs HAO1 Human-Mouse Common DsiRNAs Knockdown in Human HeLa Cells
Psi-Check-HsHAO1 Plasmid
RLuc Remaining vs. NC1, NC5, NC7

Hs HAO1 Human Unique DsiRNAs Knockdown in Human HeLa Cells
Psi-Check-HsHAO1 Plasmid
RLuc Remaining vs. NC1, NC5, NC7

Human-Mouse Common HAO1 DsiRNAs – Knockdown in Mouse Hepa1-6 Cells, Normalized to Mm HPRT 576-664 (HEX) and Mm RPL23 139-249 (FAM) vs M107-M48|NC1 Control, M107-M48|NC5 Control, M107-M48|NC7 Control Human HAO1 Knockdown - Human (HeLa) Cells ~ Phase 2
Psi-Check-HsHAO1 Plasmid; RLuc Remaining vs. NC1, NC5, NC7
Key:
P1, P2 at 1nM
P2 at 0.1nM
% Signal Remaining
Hs HAO1 DsiRNA
% Signal Remaining
Hs HAO1 DsiRNA Human HAO1 Knockdown - Human (HeLa) Cells – Phase 2
Psi-Check-HsHAO1 Plasmid; RLuc Remaining vs. NC1, NC5, NC7
Key:
P1, P2 at 1nM
P2 at 0.1nM
% Signal Remaining
Hs HAO1 DsiRNA
% Signal Remaining
Hs HAO1 DsiRNA Mouse HAO1 mRNA Knockdown – Mouse (Hepa1-6) Cells – Phase 2
Normalized to Mm HPRT (576-664, HEX) and Mm RPL23 (139-249, FAM); vs NC1, NC5, NC7
Key:
P1, P2 at 1nM
P2 at 0.1nM
Assay
Mm HAO1
476-611 (FAM)
Mm HAO1
1775-1888 (HEX)
% mRNA Remaining Mouse HAO1 mRNA Knockdown – Mouse (Hepa1-6) Cells – Phase 2
Normalized to Mm HPRT (576-664, HEX) and Mm RPL23 (139-249, FAM); vs NC1, NC5, NC7
Key: P1, P2 at 1nM
P2 at 0.1nM
Assay
Mm HAO1 476-611 (FAM)
Mm HAO1 1775-1888 (HEX)
% mRNA Remaining Mouse HAO1 mRNA Knockdown – Mouse (Hepa1-6) Cells – Phase 2
Normalized to Mm HPRT (576-664, HEX) and Mm RPL23 (139-249, FAM); vs NC1, NC5, NC7
Key: P1, P2 at 1nM
P2 at 0.1nM
Assay
Mm HAO1
476-611 (FAM)
Mm HAO1
1775-1888 (HEX)
% mRNA Remaining
% mRNA Remaining Human HAO1 Knockdown - Human (HeLa) Cells – Phase 3
Psi-Check-HsHAO1 Plasmid; RLuc Remaining vs. NC1, NC5, NC7
Key:
P2, P3 at 1nM
P3 at 0.1nM
% Signal Remaining
Hs HAO1 DsiRNA
% Signal Remaining
Hs HAO1 DsiRNA Human HAO1 Knockdown - Human (HeLa) Cells – Phase 3

Psi-Check-HsHAO1 Plasmid; RLuc Remaining vs. NC1, NC5, NC7

Mouse HAO1 mRNA Knockdown – Mouse (Hepa1-6) Cells – Phase 3
Normalized to Mm HPRT (576-664, HEX) and Mm RPL23 (139-249, FAM); vs NC1, NC5, NC7
Key:
P2, P3 at 1nM
P3 at 0.1nM
P3 at 0.03nM
Assay
Mm HAO1
476-611 (FAM)
Mm HAO1
1775-1888 (HEX)
% mRNA Remaining
Mm HAO1 DsiRNA Location Mouse HAO1 mRNA Knockdown – Mouse (Hepa1-6) Cells – Phase 3
Normalized to Mm HPRT (576-664, HEX) and Mm RPL23 (139-249, FAM); vs NC1, NC5, NC7

Mouse HAO1 mRNA Knockdown – Mouse (Hepa1-6) Cells – Phase 4
Normalized to Mm HPRT (576-664, HEX) and Mm RPL23 (139-249, FAM); vs NC1, NC5, NC7
Key:
P2, P4 at 1nM
P4 at 0.1nM
P4 at 0.03nM
Assay
Mm HAO1
476-611 (FAM)
Mm HAO1
1775-1888 (HEX)
% mRNA Remaining
% mRNA Remaining
Mm HAO1 DsiRNA Location

Modification Patterns, Phase 5 Screen

Modification Patterns, Phase 5 Screen (Cont.)

Modification Patterns, Phase 5 Screen (Cont.)

Modification Patterns, Phase 5 Screen (Cont.)

Phase 5 Hs HAO1 Knockdown in HeLa Cells
Psi-Check-HsHAO1 Plasmid
RLuc Remaining vs. NC1, NC5, NC7

Phase 5 Hs HAO1 Knockdown in HeLa Cells
Psi-Check-HsHAO1 Plasmid
RLuc Remaining vs. NC1, NC5, NC7

Phase 5 Hs HAO1 Knockdown in HeLa Cells
Psi-Check-HsHAO1 Plasmid
RLuc Remaining vs. NC1, NC5, NC7

Phase 5 Hs HAO1 Knockdown in HeLa Cells
Psi-Check-HsHAO1 Plasmid
RLuc Remaining vs. NC1, NC5, NC7

Phase 5 HAO1 Knockdown in Human HEK293-pcDNA_HAO1 Cells
Normalized to Hs HPRT 517-591 (FAM) and Hs SFRS9 594-690 (HEX) vs M14-M48|NC1 Control, M14-M48|NC5 Control, M14-M48|NC7 Control
Key:
P5 Luc, P5 at 1nM
P5 at 0.1nM
Assay
Hs HAO1
295-409 (FAM)
Hs HAO1
1596-1678 (HEX)
% mRNA Remaining
% mRNA Remaining Phase 5 HAO1 Knockdown in Human HEK293-pcDNA_HAO1 Cells Normalized to Hs HPRT 517-591 (FAM) and Hs SFRS9 594-690 (HEX) vs M14-M48|NC1 Control, M14-M48|NC5 Control, M14-M48|NC7 Control Phase 5 HAO1 Knockdown in Human HEK293-pcDNA_HAO1 Cells
Normalized to Hs HPRT 517-591 (FAM) and Hs SFRS9 594-690 (HEX) vs M14-M48|NC1 Control, M14-M48|NC5 Control, M14-M48|NC7 Control Phase 5 HAO1 Knockdown in Human HEK293-pcDNA_HAO1 Cells
Normalized to Hs HPRT 517-591 (FAM) and Hs SFRS9 594-690 (HEX) vs M14-M48|NC1 Control, M14-M48|NC5 Control, M14-M48|NC7 Control
Key:
P5 Luc, P5 at 1nM
P5 at 0.1nM
Assay
Hs HAO1 295-409 (FAM)
Hs HAO1 1596-1678 (HEX)
% mRNA Remaining Modification Patterns, Phase 6 Screen

Modification Patterns, Phase 6 Screen (Cont.)

Modification Patterns, Phase 6 Screen (Cont.)

Modification Patterns, Phase 6 Screen (Cont.)

Modification Patterns, Phase 6 Screen (Cont.)

Modification Patterns, Phase 6 Screen (Cont.)

Modification Patterns, Phase 6 Screen (Cont.)

Modification Patterns, Phase 6 Screen (Cont.)

Modification Patterns, Phase 6 Screen (Cont.)
= 2' O-Me
= RNA
= DNA
= Ago2 site
= Dicer site
M14-M17
M14-M224
M14-M225
M14-M226
M260-M17
M260-M224
M260-M225
M260-M226
5'
3'
Sense
Antisense

Modification Patterns, Phase 6 Screen (Cont.)

Modification Patterns, Phase 6 Screen (Cont.)

Phase 6 HAO1 Knockdown in Human HEK293-pcDNA_HAO1 Cells Normalized to Hs HPRT 517-591 (FAM) and Hs SFRS9 594-690 (HEX) vs M14-M48|NC1 Control, M14-M48|NC5 Control, M14-M48|NC7 Control

Phase 6 HAO1 Knockdown in Human HEK293-pcDNA_HAO1 Cells Normalized to Hs HPRT 517-591 (FAM) and Hs SFRS9 594-690 (HEX) vs M14-M48|NC1 Control, M14-M48|NC5 Control, M14-M48|NC7 Control Phase 6 HAO1 Knockdown in Human HEK293-pcDNA_HAO1 Cells Normalized to Hs HPRT 517-591 (FAM) and Hs SFRS9 594-690 (HEX) vs M14-M48|NC1 Control, M14-M48|NC5 Control, M14-M48|NC7 Control Phase 6 HAO1 Knockdown in Human HEK293-pcDNA_HAO1 Cells
Normalized to Hs HPRT 517-591 (FAM) and Hs SFRS9 594-690 (HEX) vs M14-M48|NC1 Control, M14-M48|NC5 Control, M14-M48|NC7 Control
Key:
P6 at 1nM
P6 at 0.1nM
Assay
Hs HAO1
295-409 (FAM)
Hs HAO1
1596-1678 (HEX)
% mRNA Remaining

Figure 12A

Parent: HAO1-1171-301/245 f = 2'-fluoro r = ribo iB = inverted basic s = phosphorothioate (PS) linkage d = deoxy m = 2'-O-methyl

| DsiRNA # | | |
|---|---|---|
| 1 | 5'->3' | [mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][mA][mU][mA][mC][fA][mG][mA][mU][rG][rG][rG][rA][fA][fA][mA][mU][fA][mU][mUs][mG] |
| 2 | 5'->3' | [mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][mA][mU][mA][mC][fA][mG][mA][mU][rGs][rGs][rGs][rA][fA][fA][mA][mU][fA][mU][mUs][mG] |
| 3 | 5'->3' | [iB][fAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][mA][mU][mA][mC][fA][mG][mA][mU][rG][rG][rG][rA][fA][fA][mA][mU][fA][mUs][mUs][mG] |
| 4 | 5'->3' | [iB][mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][mA][mU][mA][mC][fA][mG][mA][mU][rG][rG][rG][rA][fA][fA][mA][mU][fA][mUs][mUs][mG] |
| 5 | 5'->3' | [mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][mA][mU][mA][mC][fA][mG][mA][mU][rG][rG][rG][fA][fA][fA][mA][mU][fA][mU][mUs][mG] |
| 6 | 5'->3' | [iB][mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][mA][mU][mA][mC][fA][mG][mA][mU][rG][rG][rG][fA][fA][fA][mA][mU][fA][mUs][mUs][mG] |
| 7 | 5'->3' | [fAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][mA][mU][mA][mC][fA][mG][mA][mU][rG][rG][rG][fA][fA][fA][mA][mU][fA][mU][mUs][mG] |
| 8 | 5'->3' | [mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][mA][mU][mA][mC][fA][mG][mA][mU][fG][fG][fG][fA][fA][fA][mA][mU][fA][mU][mUs][mG] |
| 9 | 5'->3' | [iB][mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][mA][mU][mA][mC][fA][mG][mA][mU][fG][fG][fG][fA][fA][fA][mA][mU][fA][mUs][mUs][mG] |
| 10 | 5'->3' | [fAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][mA][mU][mA][mC][fA][mG][mA][mU][fG][fG][fG][fA][fA][fA][mA][mU][fA][mU][mUs][mG] |
| 11 | 5'->3' | [fAs][mU][fA][mU][mU][mU][mU][fC][rC][rC][fA][fU][fC][mU][mG][mU][fA][mU][mU][fA][rU][rU][fU][dTs][dT] |
| | 5'->3' | [mAs][mA][mA][mA][rA][rU][rA][mA][mU][mA][mC][fA][mG][mA][mU][fG][fG][fG][fA][fA][fA][mA][mU][fA][mU][mUs][mG] |
| 12 | 5'->3' | [fAs][mU][fA][mU][mU][mU][mU][fCs][rC][rCs][fA][fU][fC][mU][mG][mU][fA][mU][mU][fA][rU][rU][fU][dTs][dT] |
| | 5'->3' | [mAs][mA][mA][mA][rA][rU][rA][mA][mU][mA][mC][fA][mG][mA][mU][fG][fG][fG][fA][fA][fA][mA][mU][fA][mU][mUs][mG] |

Figure 12B

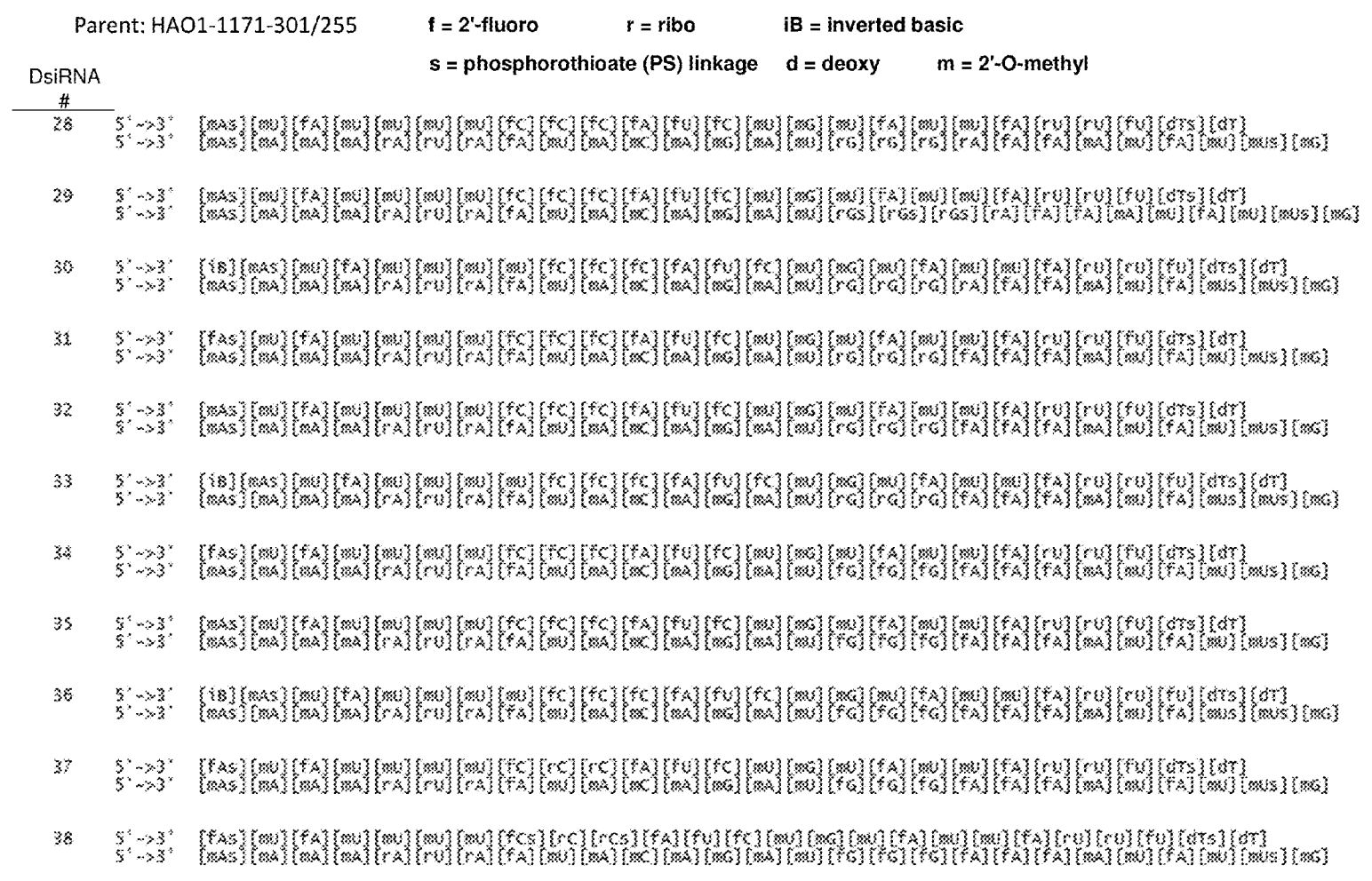

Parent: HAO1-1171-301/255    f = 2'-fluoro    r = ribo    iB = inverted basic s = phosphorothioate (PS) linkage    d = deoxy    m = 2'-O-methyl

| DsiRNA # | | |
|---|---|---|
| 28 | 5'->3' | [mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][fA][mU][mA][mC][mA][mG][mA][mU][rG][rG][rG][rA][fA][fA][mA][mU][fA][mU][mUs][mG] |
| 29 | 5'->3' | [mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][fA][mU][mA][mC][mA][mG][mA][mU][rGs][rGs][rGs][rA][fA][fA][mA][mU][fA][mU][mUs][mG] |
| 30 | 5'->3' | [iB][mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][fA][mU][mA][mC][mA][mG][mA][mU][rG][rG][rG][rA][fA][fA][mA][mU][fA][mUs][mUs][mG] |
| 31 | 5'->3' | [fAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][fA][mU][mA][mC][mA][mG][mA][mU][rG][rG][rG][fA][fA][fA][mA][mU][fA][mU][mUs][mG] |
| 32 | 5'->3' | [mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][fA][mU][mA][mC][mA][mG][mA][mU][rG][rG][rG][fA][fA][fA][mA][mU][fA][mU][mUs][mG] |
| 33 | 5'->3' | [iB][mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][fA][mU][mA][mC][mA][mG][mA][mU][rG][rG][rG][fA][fA][fA][mA][mU][fA][mUs][mUs][mG] |
| 34 | 5'->3' | [fAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][fA][mU][mA][mC][mA][mG][mA][mU][fG][fG][fG][fA][fA][fA][mA][mU][fA][mU][mUs][mG] |
| 35 | 5'->3' | [mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][fA][mU][mA][mC][mA][mG][mA][mU][fG][fG][fG][fA][fA][fA][mA][mU][fA][mU][mUs][mG] |
| 36 | 5'->3' | [iB][mAs][mU][fA][mU][mU][mU][mU][fC][fC][fC][fA][fU][fC][mU][mG][mU][fA][mU][mU][fA][rU][rU][fU][dTs][dT] |
| | 5'->3' | [mAs][mA][mA][mA][rA][rU][rA][fA][mU][mA][mC][mA][mG][mA][mU][fG][fG][fG][fA][fA][fA][mA][mU][fA][mUs][mUs][mG] |
| 37 | 5'->3' | [fAs][mU][fA][mU][mU][mU][mU][fC][rC][rC][fA][fU][fC][mU][mG][mU][fA][mU][mU][fA][rU][rU][fU][dTs][dT] |
| | 5'->3' | [mAs][mA][mA][mA][rA][rU][rA][fA][mU][mA][mC][mA][mG][mA][mU][fG][fG][fG][fA][fA][fA][mA][mU][fA][mU][mUs][mG] |
| 38 | 5'->3' | [fAs][mU][fA][mU][mU][mU][mU][fCs][rC][rCs][fA][fU][fC][mU][mG][mU][fA][mU][mU][fA][rU][rU][fU][dTs][dT] |
| | 5'->3' | [mAs][mA][mA][mA][rA][rU][rA][fA][mU][mA][mC][mA][mG][mA][mU][fG][fG][fG][fA][fA][fA][mA][mU][fA][mU][mUs][mG] |

Figure 12C

Parent: HAO1-1376-306/250 f = 2'-fluoro r = ribo iB = inverted basic s = phosphorothioate (PS) linkage d = deoxy m = 2'-O-methyl

| DsiRNA # | | |
|---|---|---|
| 46 | 5'->3' | [mUs][mG][fG][mA][mA][mA][fU][mA][fU][fA][mU][mU][fA][mA][fC][mU][mG][mU][fU][fA][rA][rA][fA][dAs][dG] |
| | 5'->3' | [mCs][mU][mU][mU][rU][rU][rA][fA][mC][mA][mG][fU][mU][mA][mA][rUs][rAs][rUs][rA][fU][mU][mU][mC][fC][mA][mGs][mG] |
| 47 | 5'->3' | [mUs][mG][fG][mA][mA][mA][fU][mA][fU][fA][mU][mU][fA][mA][fC][mU][mG][mU][fU][fA][rA][rA][fA][dAs][dG] |
| | 5'->3' | [mCs][mU][mU][mU][rU][rU][rA][fA][mC][mA][mG][fU][mU][mA][mA][rU][rA][rU][fA][fU][mU][mU][mC][fC][mA][mGs][mG] |
| 48 | 5'->3' | [iB][mUs][mG][fG][mA][mA][mA][fU][mA][fU][fA][mU][mU][fA][mA][fC][mU][mG][mU][fU][fA][rA][rA][fA][dAs][dG] |
| | 5'->3' | [mCs][mU][mU][mU][rU][rU][rA][fA][mC][mA][mG][fU][mU][mA][mA][rU][rA][rU][fA][fU][mU][mU][mC][fC][mAs][mGs][mG] |
| 49 | 5'->3' | [mUs][mG][fG][mA][mA][mA][fU][mA][fU][fA][mU][mU][fA][mA][fC][mU][mG][mU][fU][fA][rA][rA][fA][dAs][dG] |
| | 5'->3' | [mCs][mU][mU][mU][rU][rU][rA][fA][mC][mA][mG][fU][mU][mA][mA][fU][fA][fU][fA][fU][mU][mU][mC][fC][mA][mGs][mG] |
| 50 | 5'->3' | [iB][mUs][mG][fG][mA][mA][mA][fU][mA][fU][fA][mU][mU][fA][mA][fC][mU][mG][mU][fU][fA][rA][rA][fA][dAs][dG] |
| | 5'->3' | [mCs][mU][mU][mU][rU][rU][rA][fA][mC][mA][mG][fU][mU][mA][mA][fU][fA][fU][fA][fU][mU][mU][mC][fC][mAs][mGs][mG] |
| 51 | 5'->3' | [mUs][mG][fG][mA][mA][mA][fU][mA][rU][rA][mU][mU][fA][mA][fC][mU][mG][mU][fU][fA][rA][rA][fA][dAs][dG] |
| | 5'->3' | [mCs][mU][mU][mU][rU][rU][rA][fA][mC][mA][mG][fU][mU][mA][mA][fU][fA][fU][fA][fU][mU][mU][mC][fC][mA][mGs][mG] |
| 52 | 5'->3' | [mUs][mG][fG][mA][mA][mA][fU][mAs][rU][rAs][mU][mU][fA][mA][fC][mU][mG][mU][fU][fA][rA][rA][fA][dAs][dG] |
| | 5'->3' | [mCs][mU][mU][mU][rU][rU][rA][fA][mC][mA][mG][fU][mU][mA][mA][fU][fA][fU][fA][fU][mU][mU][mC][fC][mA][mGs][mG] |

Figure 12D

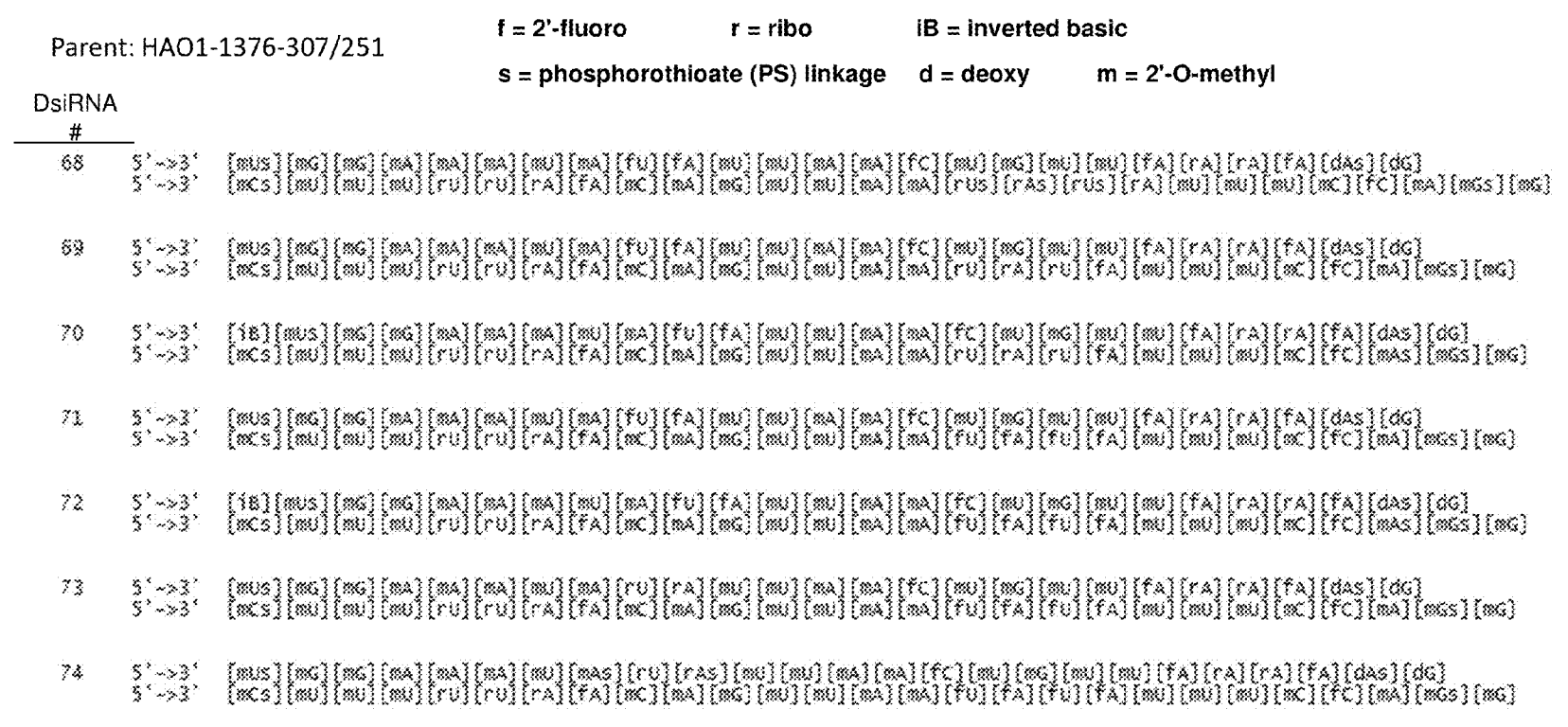

Parent: HAO1-1376-307/251 f = 2'-fluoro r = ribo iB = inverted basic s = phosphorothioate (PS) linkage d = deoxy m = 2'-O-methyl

| DsiRNA # | | |
|---|---|---|
| 68 | 5'->3' | [mUs][mG][mG][mA][mA][mA][mU][mA][fU][fA][mU][mU][mA][mA][fC][mU][mG][mU][mU][fA][rA][rA][fA][dAs][dG] |
| | 5'->3' | [mCs][mU][mU][mU][rU][rU][rA][fA][mC][mA][mG][mU][mU][mA][mA][rUs][rAs][rUs][rA][mU][mU][mU][mC][fC][mA][mGs][mG] |
| 69 | 5'->3' | [mUs][mG][mG][mA][mA][mA][mU][mA][fU][fA][mU][mU][mA][mA][fC][mU][mG][mU][mU][fA][rA][rA][fA][dAs][dG] |
| | 5'->3' | [mCs][mU][mU][mU][rU][rU][rA][fA][mC][mA][mG][mU][mU][mA][mA][rU][rA][rU][fA][mU][mU][mU][mC][fC][mA][mGs][mG] |
| 70 | 5'->3' | [iB][mUs][mG][mG][mA][mA][mA][mU][mA][fU][fA][mU][mU][mA][mA][fC][mU][mG][mU][mU][fA][rA][rA][fA][dAs][dG] |
| | 5'->3' | [mCs][mU][mU][mU][rU][rU][rA][fA][mC][mA][mG][mU][mU][mA][mA][rU][rA][rU][fA][mU][mU][mU][mC][fC][mAs][mGs][mG] |
| 71 | 5'->3' | [mUs][mG][mG][mA][mA][mA][mU][mA][fU][fA][mU][mU][mA][mA][fC][mU][mG][mU][mU][fA][rA][rA][fA][dAs][dG] |
| | 5'->3' | [mCs][mU][mU][mU][rU][rU][rA][fA][mC][mA][mG][mU][mU][mA][mA][fU][fA][fU][fA][mU][mU][mU][mC][fC][mA][mGs][mG] |
| 72 | 5'->3' | [iB][mUs][mG][mG][mA][mA][mA][mU][mA][fU][fA][mU][mU][mA][mA][fC][mU][mG][mU][mU][fA][rA][rA][fA][dAs][dG] |
| | 5'->3' | [mCs][mU][mU][mU][rU][rU][rA][fA][mC][mA][mG][mU][mU][mA][mA][fU][fA][fU][fA][mU][mU][mU][mC][fC][mAs][mGs][mG] |
| 73 | 5'->3' | [mUs][mG][mG][mA][mA][mA][mU][mA][rU][rA][mU][mU][mA][mA][fC][mU][mG][mU][mU][fA][rA][rA][fA][dAs][dG] |
| | 5'->3' | [mCs][mU][mU][mU][rU][rU][rA][fA][mC][mA][mG][mU][mU][mA][mA][fU][fA][fU][fA][mU][mU][mU][mC][fC][mA][mGs][mG] |
| 74 | 5'->3' | [mUs][mG][mG][mA][mA][mA][mU][mAs][rU][rAs][mU][mU][mA][mA][fC][mU][mG][mU][mU][fA][rA][rA][fA][dAs][dG] |
| | 5'->3' | [mCs][mU][mU][mU][rU][rU][rA][fA][mC][mA][mG][mU][mU][mA][mA][fU][fA][fU][fA][mU][mU][mU][mC][fC][mA][mGs][mG] |

METHODS AND COMPOSITIONS FOR THE SPECIFIC INHIBITION OF GLYCOLATE OXIDASE (HAO1) BY DOUBLE-STRANDED RNA

RELATED APPLICATIONS

The present application claims priority to, and the benefit under 35 U.S.C. §119(e) of U.S. provisional patent application No. 61/921,181, entitled "Methods and Compositions for the Specific Inhibition of Glycolate Oxidase (HAO1) by Double-Stranded RNA," filed Dec. 27, 2013, and of U.S. provisional application No. 61/937,838, entitled "Methods and Compositions for the Specific Inhibition of Glycolate Oxidase (HAO1) by Double-Stranded RNA," filed Feb. 10, 2014. The entire contents of the aforementioned patent applications are incorporated herein by this reference.

FIELD OF THE INVENTION

The present invention relates to compounds, compositions, and methods for the study, diagnosis, and treatment of traits, diseases and conditions that respond to the modulation of Glycolate Oxidase (HAO1) gene expression and/or activity.

SEQUENCE SUBMISSION

The present application is being filed along with a Sequence Listing in electronic format. The Sequence Listing is entitled "301937_94015 WO_seq_listing", was created on Dec. 23, 2014 and is 2.87 MB in size. The information in the electronic format of the Sequence Listing is part of the present application and is incorporated herein by reference in its entirety.

BACKGROUND OF THE INVENTION

Primary hyperoxaluria Type 1 ("PH1") is a rare autosomal recessive inborn error of glyoxylate metabolism, caused by a deficiency of the liver-specific enzyme alanine:glyoxylate aminotransferase. The disorder results in overproduction and excessive urinary excretion of oxalate, causing recurrent urolithiasis and nephrocalcinosis. As glomerular filtration rate declines due to progressive renal involvement, oxalate accumulates leading to systemic oxalosis. The diagnosis is based on clinical and sonographic findings, urine oxalate assessment, enzymology and/or DNA analysis. While early conservative treatment has aimed to maintain renal function, in chronic kidney disease Stages 4 and 5, the best outcomes to date have been achieved with combined liver-kidney transplantation (Cochat et al. *Nephrol Dial Transplant* 27: 1729-36).

PH1 is the most common form of primary hyperoxaluria and has an estimated prevalence of 1 to 3 cases per 1 million population and an incidence rate of approximately 1 case per 120,000 live births per year in Europe (Cochat et al. *Nephrol Dial Transplant* 10 (Suppl 8): 3-7; van Woerden et al. Nephrol Dial Transplant 18: 273-9). It accounts for 1 to 2% of cases of pediatric end-stage renal disease (ESRD), according to registries from Europe, the United States, and Japan (Harambat et al. *Clin J Am Soc Nephrol* 7: 458-65), but it appears to be more prevalent in countries in which consanguineous marriages are common (with a prevalence of 10% or higher in some North African and Middle Eastern nations; Kamoun and Lakhoua Pediatr Nephrol 10: 479-82; see Cochat and Rumsby *N Engl J Med* 369(7):649-58).

Glycolate oxidase (the product of the HAO1, for "hydroxyacid oxidase 1", gene) is the enzyme responsible for converting glycolate to glyoxylate in the mitochondrial/peroxisomal glycine metabolism pathway in the liver and pancreas. While glycolate is a harmless intermediate of the glycine metabolism pathway, accumulation of glyoxylate (via, e.g., AGT1 mutation) drives oxalate accumulation, which ultimately results in the PH1 disease.

Double-stranded RNA (dsRNA) agents possessing strand lengths of 25 to 35 nucleotides have been described as effective inhibitors of target gene expression in mammalian cells (Rossi et al., U.S. Pat. No. 8,084,599 and U.S. Patent Application No. 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220). Effective extended forms of Dicer substrates have also recently been described (Brown, U.S. Pat. No. 8,349,809 and U.S. Pat. No. 8,513,207).

BRIEF SUMMARY OF THE INVENTION

The present invention is based, at least in part, upon the identification of HAO1 as an attractive target for dsRNA-based knockdown therapies. In particular, provided herein are nucleic acid agents that target and reduce expression of HAO1. Such compositions contain nucleic acids such as double stranded RNA ("dsRNA"), and methods for preparing them. The nucleic acids of the invention are capable of reducing the expression of a target Glycolate Oxidase gene in a cell, either in vitro or in a mammalian subject.

In one aspect, the invention provides a nucleic acid possessing an oligonucleotide strand of 15-80 nucleotides in length, where the oligonucleotide strand is sufficiently complementary to a target HAO1 mRNA sequence of SEQ ID NOs: 1921-2304 along at least 15 nucleotides of the oligonucleotide strand length to reduce HAO1 target mRNA expression when the nucleic acid is introduced into a mammalian cell.

Another aspect of the invention provides a nucleic acid possessing an oligonucleotide strand of 19-80 nucleotides in length, where the oligonucleotide strand is sufficiently complementary to a target HAO1 mRNA sequence of SEQ ID NOs: 1921-2304 along at least 19 nucleotides of the oligonucleotide strand length to reduce HAO1 target mRNA expression when the nucleic acid is introduced into a mammalian cell.

In one embodiment, the oligonucleotide strand is 19-35 nucleotides in length.

An additional aspect of the invention provides a double stranded nucleic acid (dsNA) possessing first and second nucleic acid strands including RNA, where the first strand is 15-66 nucleotides in length and the second strand of the dsNA is 19-66 nucleotides in length, where the second oligonucleotide strand is sufficiently complementary to a target HAO1 mRNA sequence of SEQ ID NOs: 1921-2304 along at least 15 nucleotides of the second oligonucleotide strand length to reduce HAO1 target mRNA expression when the double stranded nucleic acid is introduced into a mammalian cell.

Another aspect of the invention provides a double stranded nucleic acid (dsNA) possessing first and second nucleic acid strands, where the first strand is 15-66 nucleotides in length and the second strand of the dsNA is 19-66 nucleotides in length, where the second oligonucleotide strand is sufficiently complementary to a target HAO1 mRNA sequence of SEQ ID NOs: 1921-2304 along at least 19 nucleotides of the second oligonucleotide strand length to reduce HAO1 target mRNA expression when the double stranded nucleic acid is introduced into a mammalian cell.

A further aspect of the invention provides a double stranded nucleic acid (dsNA) possessing first and second nucleic acid strands, where the first strand is 15-66 nucleotides in length and the second strand of the dsNA is 19-66 nucleotides in length, where the second oligonucleotide strand is sufficiently complementary to a target HAO1 mRNA sequence of SEQ ID NOs: 1921-2304 along at least 19 nucleotides of the second oligonucleotide strand length to reduce HAO1 target mRNA expression, and where, starting from the 5' end of the HAO1 mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell.

Another aspect of the invention provides a dsNA molecule, consisting of: (a) a sense region and an antisense region, where the sense region and the antisense region together form a duplex region consisting of 25-66 base pairs and the antisense region includes a sequence that is the complement of a sequence of SEQ ID NOs: 1921-2304; and (b) from zero to two 3' overhang regions, where each overhang region is six or fewer nucleotides in length, and where, starting from the 5' end of the HAO1 mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell.

An additional aspect of the invention provides a double stranded nucleic acid (dsNA) possessing first and second nucleic acid strands and a duplex region of at least 25 base pairs, where the first strand is 25-65 nucleotides in length and the second strand of the dsNA is 26-66 nucleotides in length and includes 1-5 single-stranded nucleotides at its 3' terminus, where the second oligonucleotide strand is sufficiently complementary to a target HAO1 mRNA sequence of SEQ ID NOs: 1921-2304 along at least 19 nucleotides of the second oligonucleotide strand length to reduce HAO1 target gene expression when the double stranded nucleic acid is introduced into a mammalian cell.

Another aspect of the invention provides a double stranded nucleic acid (dsNA) possessing first and second nucleic acid strands and a duplex region of at least 25 base pairs, where the first strand is 25-65 nucleotides in length and the second strand of the dsNA is 26-66 nucleotides in length and includes 1-5 single-stranded nucleotides at its 3' terminus, where the 3' terminus of the first oligonucleotide strand and the 5' terminus of the second oligonucleotide strand form a blunt end, and the second oligonucleotide strand is sufficiently complementary to a target HAO1 sequence of SEQ ID NOs: 1921-2304 along at least 19 nucleotides of the second oligonucleotide strand length to reduce HAO1 mRNA expression when the double stranded nucleic acid is introduced into a mammalian cell.

In one embodiment, the first strand is 15-35 nucleotides in length.

In another embodiment, the second strand is 19-35 nucleotides in length.

In an additional embodiment, the dsNA possesses a duplex region of at least 25 base pairs; 19-21 base pairs or 21-25 base pairs.

Optionally, the second oligonucleotide strand includes 1-5 single-stranded nucleotides at its 3' terminus.

In one embodiment, the second oligonucleotide strand includes 5-35 single-stranded nucleotides at its 3' terminus.

In another embodiment, the single-stranded nucleotides include modified nucleotides. Optionally, the single-stranded nucleotides include 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and/or 2'-O-(N-methlycarbamate) modified nucleotides.

In certain embodiments, the single-stranded nucleotides include ribonucleotides. Optionally, the single-stranded nucleotides include deoxyribonucleotides.

In certain embodiments, the 3' end of the first strand and the 5' end of the second strand of a dsNA or hybridization complex of the invention are joined by a polynucleotide sequence that includes ribonucleotides, deoxyribonucleotides or both, optionally the polynucleotide sequence includes a tetraloop sequence.

In one embodiment, the first strand is 25-35 nucleotides in length. Optionally, the second strand is 25-35 nucleotides in length.

In one embodiment, the second oligonucleotide strand is complementary to target HAO1 cDNA sequence GenBank Accession No. NM_017545.2 along at most 27 nucleotides of the second oligonucleotide strand length.

In another embodiment, starting from the first nucleotide (position 1) at the 3' terminus of the first oligonucleotide strand, position 1, 2 and/or 3 is substituted with a modified nucleotide.

Optionally, the first strand and the 5' terminus of the second strand form a blunt end.

In one embodiment, the first strand is 25 nucleotides in length and the second strand is 27 nucleotides in length.

In another embodiment, starting from the 5' end of a HAO1 mRNA sequence of SEQ ID NOs: 1921-2304 (position 1), mammalian Ago2 cleaves the mRNA at a site between positions 9 and 10 of the sequence, thereby reducing HAO1 target mRNA expression when the double stranded nucleic acid is introduced into a mammalian cell.

In one embodiment, the second strand includes a sequence of SEQ ID NOs: 385-768. In an additional embodiment, the first strand includes a sequence of SEQ ID NOs: 1-384.

In another embodiment, the dsNA of the invention possesses a pair of first strand/second strand sequences of Table 2.

Optionally, the modified nucleotide residue of the 3' terminus of the first strand is a deoxyribonucleotide, an acyclonucleotide or a fluorescent molecule.

In one embodiment, position 1 of the 3' terminus of the first oligonucleotide strand is a deoxyribonucleotide.

In another embodiment, the nucleotides of the 1-5 or 5-35 single-stranded nucleotides of the 3' terminus of the second strand comprise a modified nucleotide.

In one embodiment, the modified nucleotide of the 1-5 or 5-35 single-stranded nucleotides of the 3' terminus of the second strand is a 2'-O-methyl ribonucleotide.

In an additional embodiment, all nucleotides of the 1-5 or 5-35 single-stranded nucleotides of the 3' terminus of the second strand are modified nucleotides.

In another embodiment, the dsNA includes a modified nucleotide. Optionally, the modified nucleotide residue is 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino or 2'-O-(N-methlycarbamate).

In one embodiment, the 1-5 or 5-35 single-stranded nucleotides of the 3' terminus of the second strand are 1-3 nucleotides in length, optionally 1-2 nucleotides in length.

In another embodiment, the 1-5 or 5-35 single-stranded nucleotides of the 3' terminus of the second strand is two nucleotides in length and includes a 2'-O-methyl modified ribonucleotide.

In one embodiment, the second oligonucleotide strand includes a modification pattern of AS-M1 to AS-M96 and AS-M1* to AS-M96*.

In another embodiment, the first oligonucleotide strand includes a modification pattern of SM1 to SM119.

In an additional embodiment, each of the first and the second strands has a length which is at least 26 and at most 30 nucleotides.

In one embodiment, the dsNA is cleaved endogenously in the cell by Dicer.

In another embodiment, the amount of the nucleic acid sufficient to reduce expression of the target gene is of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of the cell.

In one embodiment, the dsNA possesses greater potency than a 21mer siRNA directed to the identical at least 19 nucleotides of the target HAO1 mRNA in reducing target HAO1 mRNA expression when assayed in vitro in a mammalian cell at an effective concentration in the environment of a cell of 1 nanomolar or less.

In an additional embodiment, the nucleic acid or dsNA is sufficiently complementary to the target HAO1 mRNA sequence to reduce HAO1 target mRNA expression by an amount (expressed by %) of at least 10%, at least 50%, at least 80-90%, at least 95%, at least 98%, or at least 99% when the double stranded nucleic acid is introduced into a mammalian cell.

In one embodiment, the first and second strands are joined by a chemical linker.

In another embodiment, the 3' terminus of the first strand and the 5' terminus of the second strand are joined by a chemical linker.

In an additional embodiment, a nucleotide of the second or first strand is substituted with a modified nucleotide that directs the orientation of Dicer cleavage.

In one embodiment, the nucleic acid, dsNA or hybridization complex possesses a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid modified nucleotide.

In another embodiment, the nucleic acid, dsNA or hybridization complex includes a phosphonate, a phosphorothioate or a phosphotriester phosphate backbone modification.

In one embodiment, the nucleic acid, dsNA or hybridization complex includes a morpholino nucleic acid or a peptide nucleic acid (PNA).

In an additional embodiment, the nucleic acid, dsNA or hybridization complex is attached to a dynamic polyconjugate (DPC).

In one embodiment, the nucleic acid, dsNA or hybridization complex is administered with a DPC, where the dsNA and DPC are optionally not attached.

In another embodiment, the nucleic acid, dsNA or hybridization complex is attached to a GalNAc moiety, a cholesterol and/or a cholesterol targeting ligand.

Another aspect of the invention provides a composition of the following:

a dsNA possessing first and second nucleic acid strands, where the first strand is 15-35 nucleotides in length and the second strand of the dsNA is 19-35 nucleotides in length, where the second oligonucleotide strand is sufficiently complementary to a target HAO1 mRNA sequence of SEQ ID NOs: 1921-2304 along at least 19 nucleotides of the second oligonucleotide strand length to reduce HAO1 target mRNA expression when the double stranded nucleic acid is introduced into a mammalian cell;

a dsNA possessing first and second nucleic acid strands, where the first strand is 15-35 nucleotides in length and the second strand of the dsNA is 19-35 nucleotides in length, where the second oligonucleotide strand is sufficiently complementary to a target HAO1 mRNA sequence of SEQ ID NOs: 1921-2304 along at least 19 nucleotides of the second oligonucleotide strand length to reduce HAO1 target mRNA expression, and where, starting from the 5' end of the HAO1 mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell;

a dsNA molecule, consisting of: (a) a sense region and an antisense region, where the sense region and the antisense region together form a duplex region consisting of 25-35 base pairs and the antisense region includes a sequence that is the complement of a sequence of SEQ ID NOs: 1921-2304; and (b) from zero to two 3' overhang regions, where each overhang region is six or fewer nucleotides in length, and where, starting from the 5' end of the HAO1 mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell;

a dsNA possessing first and second nucleic acid strands and a duplex region of at least 25 base pairs, where the first strand is 25-34 nucleotides in length and the second strand of the dsNA is 26-35 nucleotides in length and includes 1-5 single-stranded nucleotides at its 3' terminus, where the second oligonucleotide strand is sufficiently complementary to a target HAO1 mRNA sequence of SEQ ID NOs: 1921-2304 along at least 19 nucleotides of the second oligonucleotide strand length to reduce HAO1 target gene expression when the double stranded nucleic acid is introduced into a mammalian cell;

a dsNA possessing first and second nucleic acid strands and a duplex region of at least 25 base pairs, where the first strand is 25-34 nucleotides in length and the second strand of the dsNA is 26-35 nucleotides in length and includes 1-5 single-stranded nucleotides at its 3' terminus, where the 3' terminus of the first oligonucleotide strand and the 5' terminus of the second oligonucleotide strand form a blunt end, and the second oligonucleotide strand is sufficiently complementary to a target HAO1 sequence of SEQ ID NOs: 1921-2304 along at least 19 nucleotides of the second oligonucleotide strand length to reduce HAO1 mRNA expression when the double stranded nucleic acid is introduced into a mammalian cell;

a nucleic acid possessing an oligonucleotide strand of 19-35 nucleotides in length, where the oligonucleotide strand is sufficiently complementary to a target HAO1 mRNA sequence of SEQ ID NOs: 1921-2304 along at least 19 nucleotides of the oligonucleotide strand length to reduce HAO1 target mRNA expression when the nucleic acid is introduced into a mammalian cell;

a nucleic acid possessing an oligonucleotide strand of 15-35 nucleotides in length, where the oligonucleotide strand is hybridizable to a target HAO1 mRNA sequence of SEQ ID NOs: 1921-2304 along at least 15 nucleotides of the oligonucleotide strand length;

a dsNA possessing first and second nucleic acid strands possessing RNA, where the first strand is 15-35 nucleotides in length and the second strand of the dsNA is 19-35 nucleotides in length, where the second oligonucleotide strand is hybridizable to a target HAO1 mRNA sequence of SEQ ID NOs: 1921-2304 along at least 15 nucleotides of the second oligonucleotide strand length;

a dsNA possessing first and second nucleic acid strands possessing RNA, where the first strand is 15-35 nucleotides in length and the second strand of the dsNA is at least 35 nucleotides in length and optionally includes a sequence of at least 25 nucleotides in length of SEQ ID NOs: 385-768, where the second oligonucleotide strand is sufficiently complementary to a target HAO1 mRNA sequence of SEQ ID NOs: 1921-2304 along at least 15 nucleotides of the second oligonucleotide strand length to reduce HAO1 target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where the first strand is 25 to 53 nucleotide residues in length, where starting from the first nucleotide (position 1) at the 5' terminus of the first strand, positions 1 to 23 of the first strand are ribonucleotides or modified ribonucleotides; the second strand is 27 to 53 nucleotide residues in length and includes 23 consecutive ribonucleotides or modified ribonucleotides that base pair with the ribonucleotides or ribonucleotides of positions 1 to 23 of the first strand to form a duplex; the 5' terminus of the first strand and the 3' terminus of the second strand form a structure of a blunt end, a 1-6 nucleotide 5' overhang and a 1-6 nucleotide 3' overhang; the 3' terminus of the first strand and the 5' terminus of the second strand form a structure of a blunt end, a 1-6 nucleotide 5' overhang and a 1-6 nucleotide 3' overhang; at least one of positions 24 to the 3' terminal nucleotide residue of the first strand is a deoxyribonucleotide or modified ribonucleotide that optionally base pairs with a deoxyribonucleotide of the second strand; and the second strand is sufficiently complementary to a target HAO1 mRNA sequence of SEQ ID NOs: 1921-2304 along at least 15 nucleotides of the second oligonucleotide strand length to reduce HAO1 target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where the second strand is 27 to 53 nucleotide residues in length, where starting from the first nucleotide (position 1) at the 5' terminus of the second strand, positions 1 to 23 of the second strand are ribonucleotides or modified ribonucleotides; the first strand is 25 to 53 nucleotide residues in length and includes 23 consecutive ribonucleotides or modified ribonucleotides that base pair sufficiently with the ribonucleotides of positions 1 to 23 of the second strand to form a duplex; at least one of positions 24 to the 3' terminal nucleotide residue of the second strand is a deoxyribonucleotide or modified ribonucleotide, optionally that base pairs with a deoxyribonucleotide or modified ribonucleotide of the first strand; and the second strand is sufficiently complementary to a target HAO1 mRNA sequence of SEQ ID NOs: 1921-2304 along at least 15 nucleotides of the second oligonucleotide strand length to reduce HAO1 target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand (or the second strand) is 25-30 nucleotide residues in length, where starting from the 5' terminal nucleotide (position 1) positions 1 to 23 of the first strand (or the second strand) include at least 8 ribonucleotides; the second strand (or the first strand) is 36-66 nucleotide residues in length and, starting from the 3' terminal nucleotide, includes at least 8 ribonucleotides in the positions paired with positions 1-23 of the first strand to form a duplex; where at least the 3' terminal nucleotide of the second strand (or the first strand) is unpaired with the first strand (or the second strand), and up to 6 consecutive 3' terminal nucleotides are unpaired with the first strand (or the second strand), thereby forming a 3' single stranded overhang of 1-6 nucleotides; where the 5' terminus of the second strand (or the first strand) includes from 10-30 consecutive nucleotides which are unpaired with the first strand (or the second strand), thereby forming a 10-30 nucleotide single stranded 5' overhang; where at least the first strand (or the second strand) 5' terminal and 3' terminal nucleotides are base paired with nucleotides of the second strand (or first strand) when the first and second strands are aligned for maximum complementarity, thereby forming a substantially duplexed region between the first and second strands; and the second strand is sufficiently complementary to a target RNA along at least 19 ribonucleotides of the second strand length to reduce target gene expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand is 25-35 nucleotide residues in length, where starting from the 5' terminal nucleotide (position 1) positions 1 to 25 of the second strand include at least 8 ribonucleotides; the second strand is 30-66 nucleotide residues in length and, starting from the 3' terminal nucleotide, includes at least 8 ribonucleotides in the positions paired with positions 1-25 of the first strand to form a duplex; where the 5' terminus of the second strand includes from 5-35 consecutive nucleotides which are unpaired with the first strand, thereby forming a 5-35 nucleotide single stranded 5' overhang; where at least the first strand 5' terminal and 3' terminal nucleotides are base paired with nucleotides of the second strand when the first and second strands are aligned for maximum complementarity, thereby forming a substantially duplexed region between the first and second strands; and the second strand is sufficiently complementary to a target HAO1 mRNA sequence of SEQ ID NOs: 1921-2304 along at least 15 nucleotides of the second oligonucleotide strand length to reduce HAO1 target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the second strand is 19-30 nucleotide residues in length and optionally 25-30 nucleotide residues in length, where starting from the 5' terminal nucleotide (position 1) positions 1 to 17 (optionally positions 1 to 23) of the second strand include at least 8 ribonucleotides; the first strand is 24-66 nucleotide residues in length (optionally 30-66 nucleotide residues in length) and, starting from the 3' terminal nucleotide, includes at least 8 ribonucleotides in the positions paired with positions 1 to 17 (optionally positions 1 to 23) of the second strand to form a duplex; where the 3' terminus of the first strand and the 5' terminus of the second strand comprise a structure of a blunt end, a 3' overhang and a 5' overhang, optionally where the overhang is 1-6 nucleotides in length; where the 5' terminus of the first strand includes from 5-35 consecutive nucleotides which are unpaired with the second strand, thereby forming a 5-35 nucleotide single-stranded 5' overhang; where at least the second strand 5' terminal and 3' terminal nucleotides are base paired with nucleotides of the first strand when the first and second strands are aligned for maximum complementarity, thereby forming a substantially duplexed region between the first and second strands; and the second strand is sufficiently complementary to a target HAO1 mRNA sequence of SEQ ID NOs: 1921-2304 along at least 15 nucleotides of the second oligonucleotide strand length to reduce HAO1 target mRNA expression when the double stranded nucleic acid is introduced into a mammalian cell;

a dsNA possessing a first strand and a second strand, where the first strand and the second strand form a duplex region of 19-25 nucleotides in length, where the first strand includes a 3' region that extends beyond the first strand-second strand duplex region and includes a tetraloop, and the dsNA further includes a discontinuity between the 3' terminus of the first strand and the 5' terminus of the second strand, and the first or second strand is sufficiently complementary to a target HAO1 mRNA sequence of SEQ ID NOs: 1921-2304 along at least 15 nucleotides of the first or second strand length to reduce HAO1 target mRNA expression when the dsNA is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first oligonucleotide strand is 25-53 nucleotides in length and the second is oligonucleotide strand is 25-53 nucleotides in length, and where the dsNA is sufficiently highly modified to substantially prevent dicer cleavage of the dsNA, optionally where the dsNA is cleaved by non-dicer nucleases to yield one or more 19-23 nucleotide strand length dsNAs capable of reducing LDH mRNA expression in a mammalian cell;

an in vivo hybridization complex within a cell of an exogenous nucleic acid sequence and a target HAO1 mRNA sequence of SEQ ID NOs: 1921-2304; and an in vitro hybridization complex within a cell of an exogenous nucleic acid sequence and a target HAO1 mRNA sequence of SEQ ID NOs: 1921-2304.

In one embodiment, a dsNA of the invention possesses a duplex region of at least 25 base pairs, where the dsNA possesses greater potency than a 21mer siRNA directed to the identical at least 19 nucleotides of the target HAO1 mRNA in reducing target HAO1 mRNA expression when assayed in vitro in a mammalian cell at an effective concentration in the environment of a cell of 1 nanomolar or less.

In another embodiment, the dsNA of the invention has a duplex region of at least 25 base pairs, where the dsNA possesses greater potency than a 21mer siRNA directed to the identical at least 19 nucleotides of the target HAO1 mRNA in reducing target HAO1 mRNA expression when assayed in vitro in a mammalian cell at a concentration of 1 nanomolar, 200 picomolar, 100 picomolar, 50 picomolar, 20 picomolar, 10 picomolar, 5 picomolar, 2, picomolar and 1 picomolar.

In an additional embodiment, the dsNA of the invention possesses four or fewer mismatched nucleic acid residues with respect to the target HAO1 mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target HAO1 mRNA sequence.

In another embodiment, the dsNA of the invention possesses three or fewer mismatched nucleic acid residues with respect to the target HAO1 mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target HAO1 mRNA sequence.

Optionally, the dsNA of the invention possesses two or fewer mismatched nucleic acid residues with respect to the target HAO1 mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target HAO1 mRNA sequence.

In certain embodiments, the dsNA of the invention possesses one mismatched nucleic acid residue with respect to the target HAO1 mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target HAO1 mRNA sequence.

In one embodiment, 15 or 19 consecutive nucleotides of the at least 15 or 19 nucleotides of the second oligonucleotide strand are completely complementary to the target HAO1 mRNA sequence when the 15 or 19 consecutive nucleotides of the second oligonucleotide are aligned for maximum complementarity with the target HAO1 mRNA sequence.

Optionally, a nucleic acid, dsNA or hybridization complex of the invention is isolated.

Another aspect of the invention provides a method for reducing expression of a target HAO1 gene in a mammalian cell involving contacting a mammalian cell in vitro with a nucleic acid, dsNA or hybridization complex of the invention in an amount sufficient to reduce expression of a target HAO1 mRNA in the cell.

Optionally, target HAO1 mRNA expression is reduced by an amount (expressed by %) of at least 10%, at least 50% and at least 80-90%.

In one embodiment, HAO1 mRNA levels are reduced by an amount (expressed by %) of at least 90% at least 8 days after the cell is contacted with the dsNA.

In another embodiment, HAO1 mRNA levels are reduced by an amount (expressed by %) of at least 70% at least 10 days after the cell is contacted with the dsNA.

A further aspect of the invention provides a method for reducing expression of a target HAO1 mRNA in a mammal possessing administering a nucleic acid, dsNA or hybridization complex of the invention to a mammal in an amount sufficient to reduce expression of a target HAO1 mRNA in the mammal.

In one embodiment, the nucleic acid, dsNA or hybridization complex is formulated in a lipid nanoparticle (LNP).

In another embodiment, the nucleic acid, dsNA or hybridization complex is administered at a dosage of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

In certain embodiments, the nucleic acid, dsNA or hybridization complex possesses greater potency than 21mer siRNAs directed to the identical at least 19 nucleotides of the target HAO1 mRNA in reducing target HAO1 mRNA expression when assayed in vitro in a mammalian cell at an effective concentration in the environment of a cell of 1 nanomolar or less.

In one embodiment, HAO1 mRNA levels are reduced in a tissue of the mammal by an amount (expressed by %) of at least 70% at least 3 days after the dsNA is administered to the mammal.

Optionally, the tissue is liver tissue.

In certain embodiments, the administering step involves intravenous injection, intramuscular injection, intraperitoneal injection, infusion, subcutaneous injection, transdermal, aerosol, rectal, vaginal, topical, oral or inhaled delivery.

Another aspect of the invention provides a method for treating or preventing a disease or disorder in a subject that involves administering to the subject an amount of a nucleic acid, dsNA or hybridization complex of the invention in an amount sufficient to treat or prevent the disease or disorder in the subject.

In one embodiment, the disease or disorder is primary hyperoxaluria 1 (PH1).

Optionally, the subject is human.

A further aspect of the invention provides a formulation that includes the nucleic acid, dsNA or hybridization complex of the invention, where the nucleic acid, dsNA or hybridization complex is present in an amount effective to reduce target HAO1 mRNA levels when the nucleic acid, dsNA or hybridization complex is introduced into a mammalian cell in vitro by an amount (expressed by %) of at least 10%, at least 50% and at least 80-90%.

In one embodiment, the effective amount is of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of the cell.

In another embodiment, the nucleic acid, dsNA or hybridization complex is present in an amount effective to reduce target HAO1 mRNA levels when the nucleic acid, dsNA or hybridization complex is introduced into a cell of a mammalian subject by an amount (expressed by %) of at least 10%, at least 50% and at least 80-90%.

Optionally, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In another embodiment, the nucleic acid, dsNA or hybridization complex possesses greater potency than an 21mer siRNA directed to the identical at least 19 nucleotides of the target HAO1 mRNA in reducing target HAO1 mRNA levels when assayed in vitro in a mammalian cell at an effective concentration in the environment of a cell of 1 nanomolar or less.

A further aspect of the invention provides a mammalian cell containing the nucleic acid, dsNA or hybridization complex of the invention.

Another aspect of the invention provides a pharmaceutical composition that includes the nucleic acid, dsNA or hybridization complex of the invention and a pharmaceutically acceptable carrier.

An additional aspect of the invention provides a kit including the nucleic acid, dsNA or hybridization complex of the invention and instructions for its use.

A further aspect of the invention provides a composition possessing HAO1 inhibitory activity consisting essentially of a nucleic acid, dsNA or hybridization complex of the invention.

BRIEF DESCRIPTION OF THE DRAWINGS

FIG. 1 shows the structures of exemplary DsiRNA agents of the invention targeting a site in the Glycolate Oxidase RNA referred to herein as the "HAO1-1171" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted Glycolate Oxidase sequence.

FIGS. 3A and 3B) or mouse cells (Hepal-6 cell assays; FIGS. 3C to 3F). In phase 2, DsiRNAs were tested at 1 nM and 0.1 nM (in duplicate) in the environment of HeLa cells or mouse Hepal-6 cells. Individual bars represent average human (FIGS. 3A and 3B) or mouse (FIGS. 3C to 3F) Glycolate Oxidase levels observed in triplicate, with standard errors shown. Mouse Glycolate Oxidase levels were normalized to HPRT and Rp123 levels.

FIGS. 9I to 9L).

FIGS. 12A to 12F present modification patterns and sequences of extensively modified HAO1-1171 and HAO1-1376 DsiRNAs as indicated (FIGS. 12A to 12D), and associated inhibitory efficacy results (histograms of FIGS. 12E and 12F), when assayed in HEK293 cells stably transfected with HAO1 (HEK293-pcDNA HAO1 Cells), at 0.1 nM, 0.01 nM and 0.001 nM concentrations of HAO1-targeting DsiRNAs.

DETAILED DESCRIPTION OF THE INVENTION

Figure 2A:
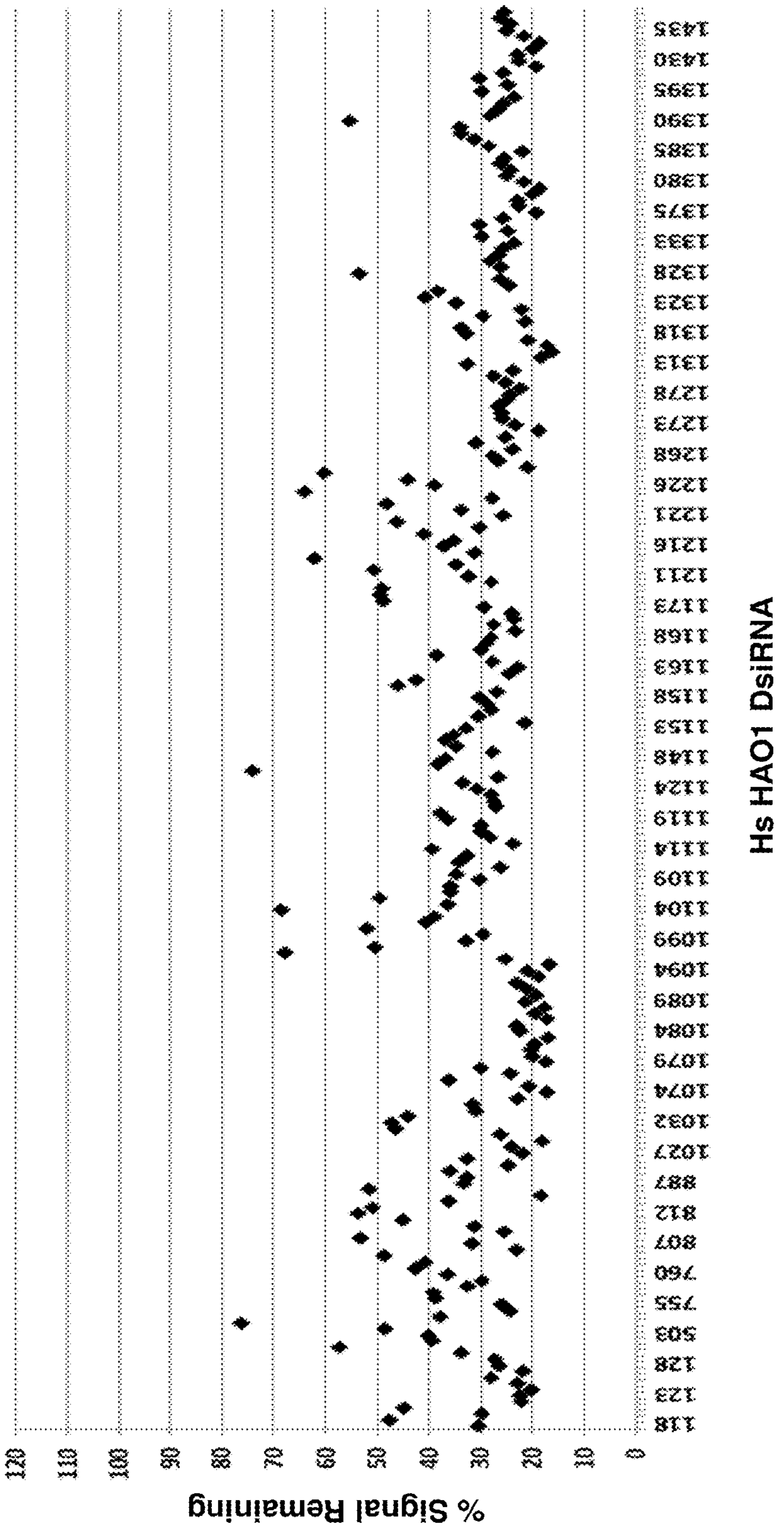
FIGS. 2A to 2F present primary screen data showing DsiRNA-mediated knockdown of human Glycolate Oxidase (FIGS. 2A and 2B show results for human-mouse common DsiRNAs, while FIGS. 2C and 2D show results for human unique DsiRNAs) and mouse Glycolate Oxidase (FIGS. 2C and 2D) in human (HeLa) and mouse (Hepal-6) cells, respectively. Activity in human HeLa cells was assessed using a Psi-Check-HsHAO1 plasmid reporter assay, monitoring for knockdown of *Renilla* luciferase production. For each DsiRNA tested in mouse cells, two independent qPCR amplicons were assayed (amplicons "476-611" and "1775-1888").
Figure 2B:
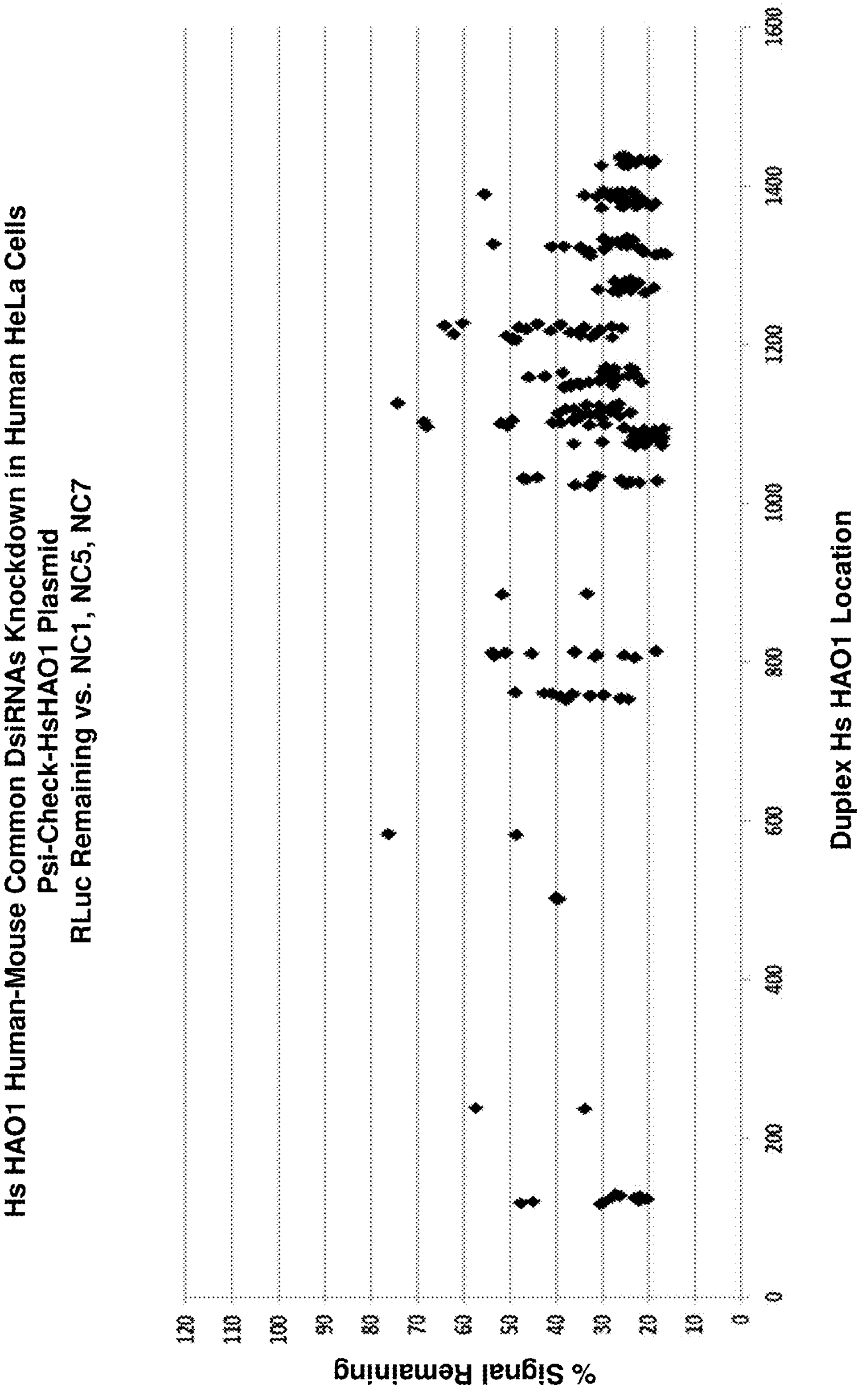
Figure 2C:
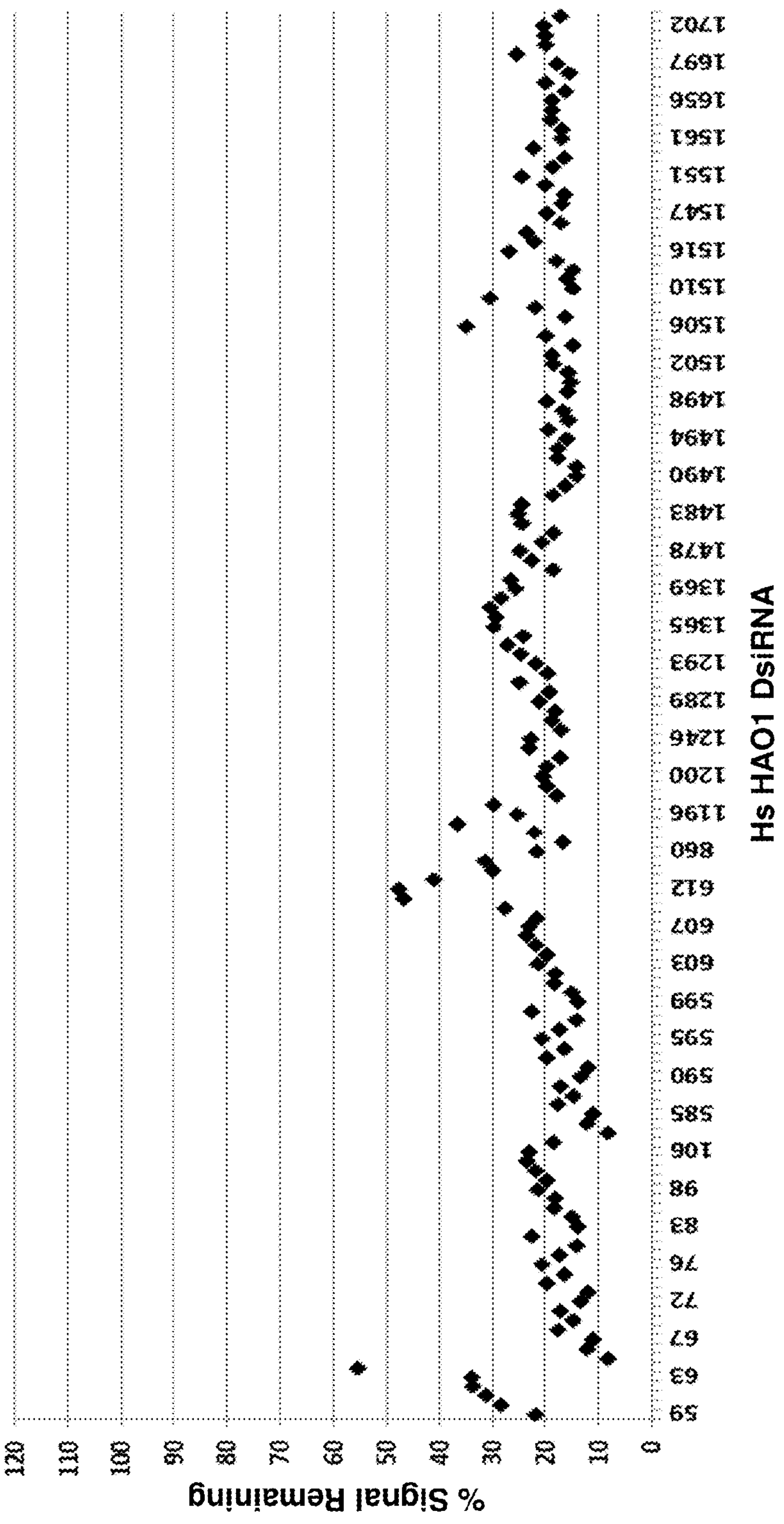
Figure 2D:
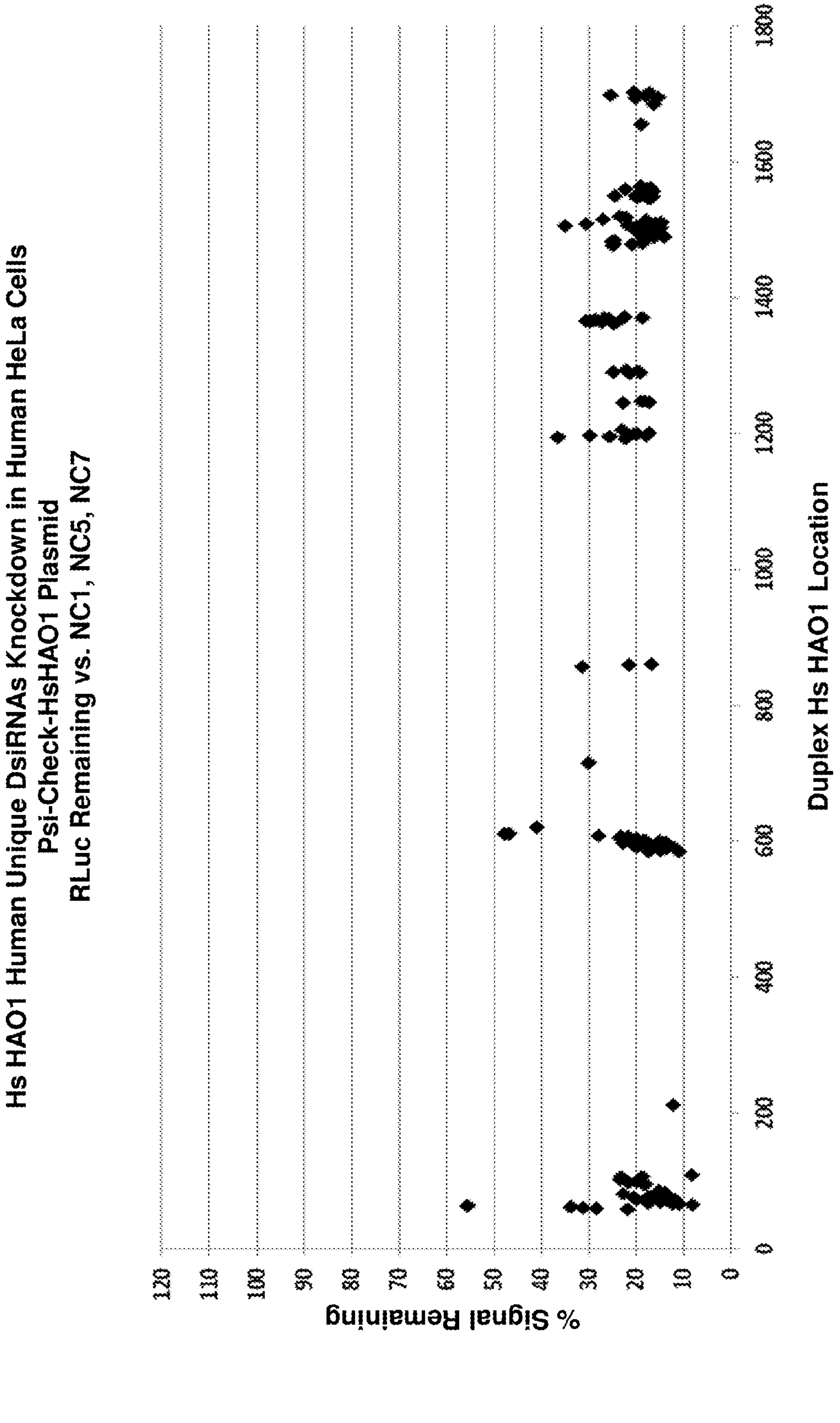
Figure 2E:
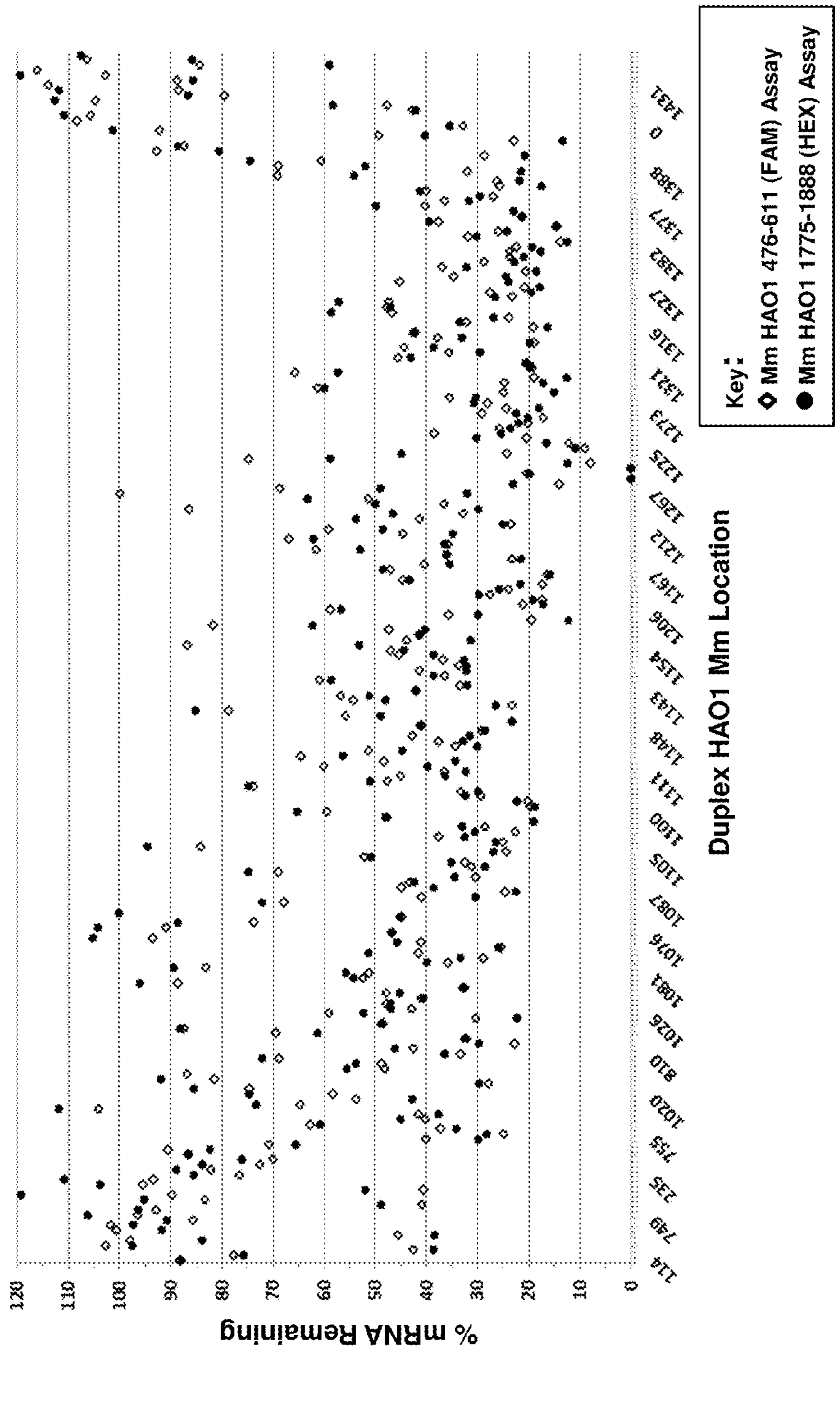
Figure 2F:
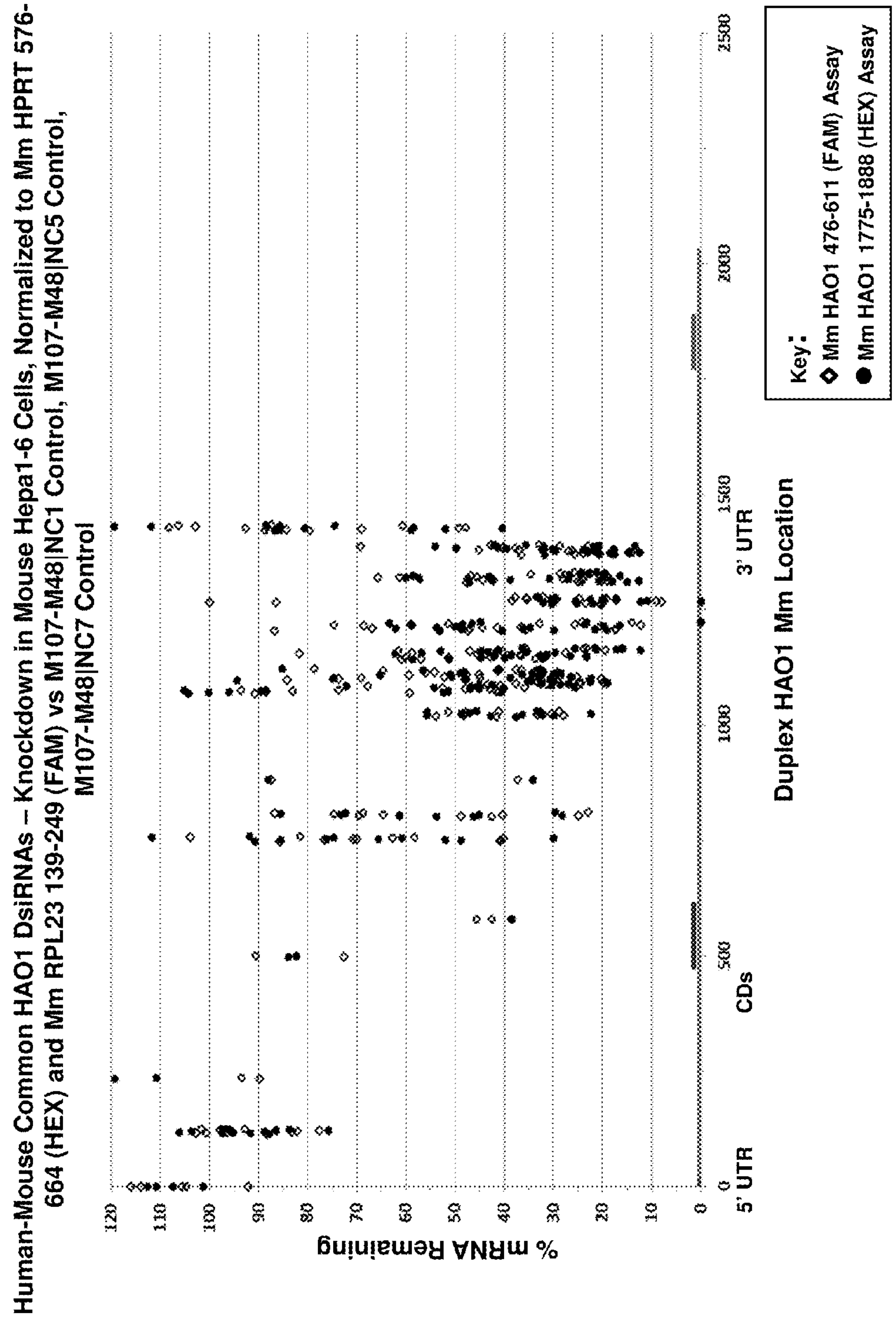

The present invention is directed to compositions that contain nucleic acids, for example double stranded RNA ("dsRNA"), and methods for preparing them, that are capable of reducing the level and/or expression of the Glycolate Oxidase (HAO1) gene in vivo or in vitro. One of the strands of the dsRNA contains a region of nucleotide sequence that has a length that ranges from 19 to 35 nucleotides that can direct the destruction and/or translational inhibition of the targeted HAO1 transcript.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) Glycolate Oxidase expression. The DsiRNAs of the invention optionally can be used in combination with modulators of other genes and/or gene products associated with the maintenance or development of diseases or disorders associated with Glycolate Oxidase misregulation (e.g., primary hyperoxaluria 1 (PH1) or other disease or disorder of the liver, kidneys, etc.). The DsiRNA agents of the invention modulate Glycolate Oxidase (Hydroxyacid Oxidase 1, HAO1) RNAs such as those corresponding to the cDNA sequences referred to by GenBank Accession Nos. NM_017545.2 (human HAO1) and NM_010403.2 (mouse HAO1), which are referred to herein generally as "Glycolate Oxidase" or "Hydroxyacid Oxidase 1."

The below description of the various aspects and embodiments of the invention is provided with reference to exemplary Glycolate Oxidase RNAs, generally referred to herein as Glycolate Oxidase. However, such reference is meant to be exemplary only and the various aspects and embodiments of the invention are also directed to alternate Glycolate Oxidase RNAs, such as mutant Glycolate Oxidase RNAs or additional Glycolate Oxidase splice variants. Certain aspects and embodiments are also directed to other genes involved in Glycolate Oxidase pathways, including genes whose misregulation acts in association with that of Glycolate Oxidase (or is affected or affects Glycolate Oxidase regulation) to produce phenotypic effects that may be targeted for treatment (e.g., glyoxylate and/or oxalate overproduction). DAO and AGT are examples of genes that interact with Glycolate Oxidase. Such additional genes, including those of pathways that act in coordination with Glycolate Oxidase, can be targeted using dsRNA and the methods described herein for use of Glycolate Oxidase-targeting dsRNAs. Thus, the inhibition or and the effects of such inhibition, or up-regulation and the effects of such, of the other genes can be performed as described herein.

The term "Glycolate Oxidase" refers to nucleic acid sequences encoding a Glycolate Oxidase protein, peptide, or polypeptide (e.g., Glycolate Oxidase transcripts, such as the sequences of Glycolate Oxidase (HAO1) Genbank Accession Nos. NM_017545.2 and NM_010403.2). In certain embodiments, the term "Glycolate Oxidase" is also meant to include other Glycolate Oxidase encoding sequence, such as other Glycolate Oxidase isoforms, mutant Glycolate Oxidase genes, splice variants of Glycolate Oxidase genes, and Glycolate Oxidase gene polymorphisms. The term "Glycolate Oxidase" is also used to refer to the polypeptide gene product of an Glycolate Oxidase gene/transcript, e.g., a Glycolate Oxidase protein, peptide, or polypeptide, such as those encoded by Glycolate Oxidase (HAO1) Genbank Accession Nos. NP_060015.1 and NP_034533.1.

As used herein, a "Glycolate Oxidase-associated disease or disorder" refers to a disease or disorder known in the art to be associated with altered Glycolate Oxidase expression, level and/or activity. Notably, a "Glycolate Oxidase-associated disease or disorder" or "HAO1-associated disease or disorder" includes diseases or disorders of the kidney, liver, skin, bone, eye and other organs including, but not limited to, primary hyperoxaluria (PH1).

In certain embodiments, dsRNA-mediated inhibition of a Glycolate Oxidase target sequence is assessed. In such embodiments, Glycolate Oxidase RNA levels can be assessed by art-recognized methods (e.g., RT-PCR, Northern blot, expression array, etc.), optionally via comparison of Glycolate Oxidase levels in the presence of an anti-Glycolate Oxidase dsRNA of the invention relative to the absence of such an anti-Glycolate Oxidase dsRNA. In certain embodiments, Glycolate Oxidase levels in the presence of an anti-Glycolate Oxidase dsRNA are compared to those observed in the presence of vehicle alone, in the presence of a dsRNA directed against an unrelated target RNA, or in the absence of any treatment.

It is also recognized that levels of Glycolate Oxidase protein can be assessed and that Glycolate Oxidase protein levels are, under different conditions, either directly or indirectly related to Glycolate Oxidase RNA levels and/or the extent to which a dsRNA inhibits Glycolate Oxidase expression, thus art-recognized methods of assessing Glycolate Oxidase protein levels (e.g., Western blot, immunoprecipitation, other antibody-based methods, etc.) can also be employed to examine the inhibitory effect of a dsRNA of the invention.

An anti-Glycolate Oxidase dsRNA of the invention is deemed to possess "Glycolate Oxidase inhibitory activity" if a statistically significant reduction in Glycolate Oxidase RNA (or when the Glycolate Oxidase protein is assessed, Glycolate Oxidase protein levels) is seen when an anti-Glycolate Oxidase dsRNA of the invention is administered to a system (e.g., cell-free in vitro system), cell, tissue or organism, as compared to a selected control. The distribution of experimental values and the number of replicate assays performed will tend to dictate the parameters of what levels of reduction in Glycolate Oxidase RNA (either as a % or in absolute terms) is deemed statistically significant (as assessed by standard methods of determining statistical significance known in the art). However, in certain embodiments, "Glycolate Oxidase inhibitory activity" is defined based upon a % or absolute level of reduction in the level of Glycolate Oxidase in a system, cell, tissue or organism. For example, in certain embodiments, a dsRNA of the invention is deemed to possess Glycolate Oxidase inhibitory activity if at least a 5% reduction or at least a 10% reduction in Glycolate Oxidase RNA is observed in the presence of a dsRNA of the invention relative to Glycolate Oxidase levels seen for a suitable control. (For example, in vivo Glycolate Oxidase levels in a tissue and/or subject can, in certain embodiments, be deemed to be inhibited by a dsRNA agent of the invention if, e.g., a 5% or 10% reduction in Glycolate Oxidase levels is observed relative to a control.) In certain other embodiments, a dsRNA of the invention is deemed to possess Glycolate Oxidase inhibitory activity if Glycolate Oxidase RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of Glycolate Oxidase is required for a dsRNA to be deemed to possess Glycolate Oxidase inhibitory activity. In certain models (e.g., cell culture), a dsRNA is deemed to possess Glycolate Oxidase inhibitory activity if at least a 50% reduction in Glycolate Oxidase levels is observed relative to a suitable control. In certain other embodiments, a dsRNA is deemed to possess Glycolate Oxidase inhibitory activity if at least an 80% reduction in Glycolate Oxidase levels is observed relative to a suitable control.

By way of specific example, in Example 2 below, a series of DsiRNAs targeting Glycolate Oxidase were tested for the ability to reduce Glycolate Oxidase mRNA levels in human HeLa or mouse Hepal-6 cells in vitro, at 1 nM concentrations in the environment of such cells and in the presence of a transfection agent (Lipofectamine™ RNAiMAX, Invitrogen). Within Example 2 below, Glycolate Oxidase inhibitory activity was ascribed to those DsiRNAs that were observed to effect at least a 50% reduction of Glycolate Oxidase mRNA levels under the assayed conditions. It is contemplated that Glycolate Oxidase inhibitory activity could also be attributed to a dsRNA under either more or less stringent conditions than those employed for Example 2 below, even when the same or a similar assay and conditions are employed. For example, in certain embodiments, a tested dsRNA of the invention is deemed to possess Glycolate Oxidase inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in Glycolate Oxidase mRNA levels is observed in a mammalian cell line in vitro at 1 nM dsRNA concentration or lower in the environment of a cell, relative to a suitable control.

Use of other endpoints for determination of whether a double stranded RNA of the invention possesses Glycolate Oxidase inhibitory activity is also contemplated. Specifically, in one embodiment, in addition to or as an alternative to assessing Glycolate Oxidase mRNA levels, the ability of a tested dsRNA to reduce Glycolate Oxidase protein levels (e.g., at 48 hours after contacting a mammalian cell in vitro or in vivo) is assessed, and a tested dsRNA is deemed to possess Glycolate Oxidase inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in Glycolate Oxidase protein levels is observed in a mammalian cell contacted with the assayed double stranded RNA in vitro or in vivo, relative to a suitable control. Additional endpoints contemplated include, e.g., assessment of a phenotype associated with reduction of Glycolate Oxidase levels—e.g., reduction of phenotypes associated with elevated levels of glyoxylate-derived deposits (e.g., deposits of calcium oxalate) throughout the body.

Glycolate Oxidase inhibitory activity can also be evaluated over time (duration) and over concentration ranges (potency), with assessment of what constitutes a dsRNA possessing Glycolate Oxidase inhibitory activity adjusted in accordance with concentrations administered and duration of time following administration. Thus, in certain embodiments, a dsRNA of the invention is deemed to possess Glycolate Oxidase inhibitory activity if at least a 50% reduction in Glycolate Oxidase activity is observed/persists at a duration of time of 2 hours, 5 hours, 10 hours, 1 day, 2 days, 3 days, 4 days, 5 days, 6 days, 7 days, 8 days, 9 days, 10 days or more after administration of the dsRNA to a cell or organism. In additional embodiments, a dsRNA of the invention is deemed to be a potent Glycolate Oxidase inhibitory agent if Glycolate Oxidase inihibitory activity (e.g., in certain embodiments, at least 50% inhibition of Glycolate Oxidase) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for Glycolate Oxidase inihibitory activity as described herein. In certain embodiments, a potent Glycolate Oxidase inhibitory dsRNA of the invention is defined as one that is capable of Glycolate Oxidase inihibitory activity (e.g., in certain embodiments, at least 20% reduction of Glycolate Oxidase levels) at a formulated concentration of 10 mg/kg or less when administered to a subject in an effective delivery vehicle (e.g., an effective lipid nanoparticle formulation). Preferably, a potent Glycolate Oxidase inhibitory dsRNA of the invention is defined as one that is capable of Glycolate Oxidase inihibitory activity (e.g., in certain embodiments, at least 50% reduction of Glycolate Oxidase levels) at a formulated concentration of 5 mg/kg or less when administered to a subject in an effective delivery vehicle. More preferably, a potent Glycolate Oxidase inhibitory dsRNA of the invention is defined as one that is capable of Glycolate Oxidase inihibitory activity (e.g., in certain embodiments, at least 50% reduction of Glycolate Oxidase levels) at a formulated concentration of 5 mg/kg or less when administered to a subject in an effective delivery vehicle. Optionally, a potent Glycolate Oxidase inhibitory dsRNA of the invention is defined as one that is capable of Glycolate Oxidase inhibitory activity (e.g., in certain embodiments, at least 50% reduction of Glycolate Oxidase levels) at a formulated concentration of 2 mg/kg or less, or even 1 mg/kg or less, when administered to a subject in an effective delivery vehicle.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23mer dsRNA directed to the same target sequence within the same target gene. For example, a DsiRNA of the invention that possesses enhanced potency relative to a corresponding 19 to 23mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an $IC_{50}$ value associated with a DsiRNA/dsRNA).

Glycolate Oxidase inhibitory levels and/or Glycolate Oxidase levels may also be assessed indirectly, e.g., measurement of a reduction of primary hyperoxaluria 1 phenotype(s) in a subject may be used to assess Glycolate Oxidase levels and/or Glycolate Oxidase inhibitory efficacy of a double-stranded nucleic acid of the instant invention.

In certain embodiments, the phrase "consists essentially of" is used in reference to the anti-Glycolate Oxidase dsRNAs of the invention. In some such embodiments, "consists essentially of" refers to a composition that comprises a dsRNA of the invention which possesses at least a certain level of Glycolate Oxidase inhibitory activity (e.g., at least 50% Glycolate Oxidase inhibitory activity) and that also comprises one or more additional components and/or modifications that do not significantly impact the Glycolate Oxidase inhibitory activity of the dsRNA. For example, in certain embodiments, a composition "consists essentially of" a dsRNA of the invention where modifications of the dsRNA of the invention and/or dsRNA-associated components of the composition do not alter the Glycolate Oxidase inhibitory activity (optionally including potency or duration of Glycolate Oxidase inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of Glycolate Oxidase inhibitory activity (e.g., 80% reduction, 90% reduction, etc. in efficacy, duration and/or potency) occurs in the presence of additional components or modifications, yet where Glycolate Oxidase inhibitory activity is not significantly elevated (e.g., observed levels of Glycolate Oxidase inhibitory activity are within 10% those observed for the isolated dsRNA of the invention) in the presence of additional components and/or modifications.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs) and unlocked nucleic acids (UNAs; see, e.g., Jensen et al. *Nucleic Acids Symposium Series* 52: 133-4), and derivatives thereof.

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, *Nucleic Acids Res.* 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-$CH_2$—O-2'-bridge, 4'-$(CH_2)_2$—O-2'-bridge, 2'-LNA or other bicyclic or "bridged" nucleoside analog, and 2'-O-(N-methylcarbamate) or those comprising base analogs. In connection with 2'-modified nucleotides as described for the present disclosure, by "amino" is meant 2'-$NH_2$ or 2'-O—$NH_2$, which can be modified or unmodified. Such modified groups are described, e.g., in Eckstein et al., U.S. Pat. No. 5,672,695 and Matulic-Adamic et al., U.S. Pat. No. 6,248,878. "Modified nucleotides" of the instant invention can also include nucleotide analogs as described above.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNMMNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4,3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S), 2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-β-D-ribofuranosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 July 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., *Nature* 1990 August 16; 346(6285):680-2; Heus and Pardi, *Science* 1991 July 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM $NaHPO_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., Nucleic Acids Res. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002.; SHINJI et al. Nippon Kagakkai Koen Yokoshu VOL. 78th; NO. 2; PAGE. 731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the Glycolate Oxidase gene/RNA.

In certain embodiments, an anti-Glycolate Oxidase DsiRNA of the instant invention possesses strand lengths of at least 25 nucleotides. Accordingly, in certain embodiments, an anti-Glycolate Oxidase DsiRNA contains one oligonucleotide sequence, a first sequence, that is at least 25 nucleotides in length and no longer than 35 or up to 50 or more nucleotides. This sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-Glycolate Oxidase DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-Glycolate Oxidase DsiRNA agent is comprised of two oligonucleotide strands of differing lengths, with the anti-Glycolate Oxidase DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-Glycolate Oxidase DsiRNA agents of the instant invention, can be found below.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5'-end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). For example, a hybridization determination buffer is shown in Table 1.

TABLE 1

| | final conc. | Vender | Cat# | Lot# | m.w./Stock | To make 50 mL solution |
|---|---|---|---|---|---|---|
| NaCl | 100 mM | Sigma | S-5150 | 41K8934 | 5M | 1 mL |
| KCl | 80 mM | Sigma | P-9541 | 70K0002 | 74.55 | 0.298 g |
| $MgCl_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| $NaH_2PO_4$ | 1 mM | Sigma | S-3193 | 52H-029515 | 120.0 | 0.006 g |
| EDTA | 0.02 mM | Sigma | E-7889 | 110K89271 | 0.5M | 2 μL |
| $H_2O$ | | Sigma | W-4502 | 51K2359 | | to 50 mL |
| pH = 7.0 at 20° C. | | | | adjust with HCl | | |

Useful variations on hybridization conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyribonucleotides ("PS-DNAs").

As used herein, "Dicer" refers to an endoribonucleases in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-base overhang on the 3' end. With respect to certain dsRNAs of the invention (e.g., "DsiRNAs"), the duplex formed by a dsRNA region of an agent of the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" can be determined as follows (e.g., see Collingwood et al., Oligonucleotides 18:187-200 (2008)). In a Dicer cleavage assay, RNA duplexes (100 pmol) are incubated in 20 μL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 bp dsRNA) is cleaved to a shorter dsRNA (e.g., 19-23 bp dsRNA, preferably, 21-23 bp dsRNA).

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) *Science* 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides. "Blunt" or "blunt end" means that there are no unpaired nucleotides at that end of the dsRNA, i.e., no nucleotide overhang. For clarity, chemical caps or non-nucleotide chemical moieties conjugated to the 3' end or 5' end of an siRNA are not considered in determining whether an siRNA has an overhang or is blunt ended. In certain embodiments, the invention provides a dsRNA molecule for inhibiting the expression of the Glycolate Oxidase target gene in a cell or mammal, wherein the dsRNA comprises an antisense strand comprising a region of complementarity which is complementary to at least a part of an mRNA formed in the expression of the Glycolate Oxidase target gene, and wherein the region of complementarity is less than 35 nucleotides in length, optionally 19-24 nucleotides in length or 25-30 nucleotides in length, and wherein the dsRNA, upon contact with a cell expressing the Glycolate Oxidase target gene, inhibits the expression of the Glycolate Oxidase target gene by at least 10%, 25%, or 40%.

A dsRNA of the invention comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the Glycolate Oxidase target gene, the other strand (the sense strand) comprises a region which is complementary to the antisense strand, such that the two strands hybridize and form a duplex structure when combined under suitable conditions. Generally, the duplex structure is between 15 and 80, or between 15 and 53, or between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., *EMBO* 20: 6877-6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Tables 4, 6, 8 or 10, minus only a few nucleotides on one or both ends may be similarly effective as compared to the dsRNAs described above and in Tables 2, 3, 5, 7 and 9. Hence, dsRNAs comprising a partial sequence of at least 15, 16, 17, 18, 19, 20, or more contiguous nucleotides sufficiently complementary to one of the sequences of Tables 4, 6, 8 or 10, and differing in their ability to inhibit the expression of the Glycolate Oxidase target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

As used herein, the term “RNA processing” refers to processing activities performed by components of the siRNA, miRNA or RNase H pathways (e.g., Drosha, Dicer, Argonaute2 or other RISC endoribonucleases, and RNaseH), which are described in greater detail below (see “RNA Processing” section below). The term is explicitly distinguished from the post-transcriptional processes of 5' capping of RNA and degradation of RNA via non-RISC- or non-RNase H-mediated processes. Such “degradation” of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase T1, RNase A (1, 2, 3, 4/5), oligonucleotidase, etc.).

By “homologous sequence” is meant a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the dsRNA agents of the instant invention contemplates the possibility of using such dsRNA agents not only against target RNAs of Glycolate Oxidase possessing perfect complementarity with the presently described dsRNA agents, but also against target Glycolate Oxidase RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said dsRNA agents. Similarly, it is contemplated that the presently described dsRNA agents of the instant invention might be readily altered by the skilled artisan to enhance the extent of complementarity between said dsRNA agents and a target Glycolate Oxidase RNA, e.g., of a specific allelic variant of Glycolate Oxidase (e.g., an allele of enhanced therapeutic interest). Indeed, dsRNA agent sequences with insertions, deletions, and single point mutations relative to the target Glycolate Oxidase sequence can also be effective for inhibition. Alternatively, dsRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions×100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) *Proc. Natl. Acad. Sci. USA* 87:2264-68, modified as in Karlin and Altschul (1993) *Proc. Natl. Acad. Sci. USA* 90:5873-77. Such an algorithm is incorporated into the BLAST programs (version 2.0) of Altschul, et al. (1990) *J. Mol. Biol.* 215:403-10.

In another embodiment, a gapped alignment, the alignment is optimized by introducing appropriate gaps, and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, a global alignment the alignment is optimized by introducing appropriate gaps, and percent identity is determined over the entire length of the sequences aligned. (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM 120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the dsRNA antisense strand and the portion of the Glycolate Oxidase RNA sequence is preferred. Alternatively, the dsRNA may be defined functionally as a nucleotide sequence (or oligonucleotide sequence) that is capable of hybridizing with a portion of the Glycolate Oxidase RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a dsRNA molecule having complementarity to an antisense region of the dsRNA molecule. In addition, the sense region of a dsRNA molecule can comprise a nucleic acid sequence having homology with a target nucleic acid sequence.

By "antisense region" is meant a nucleotide sequence of a dsRNA molecule having complementarity to a target nucleic acid sequence. In addition, the antisense region of a dsRNA molecule comprises a nucleic acid sequence having complementarity to a sense region of the dsRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target Glycolate Oxidase, in certain embodiments, the target nucleic acid is Glycolate Oxidase (HAO1) RNA, e.g., in certain embodiments, Glycolate Oxidase (HAO1) mRNA. Glycolate Oxidase RNA target sites can also interchangeably be referenced by corresponding cDNA sequences. Levels of Glycolate Oxidase may also be targeted via targeting of upstream effectors of Glycolate Oxidase, or the effects of modulated or misregulated Glycolate Oxidase may also be modulated by targeting of molecules downstream of Glycolate Oxidase in the Glycolate Oxidase signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a dsRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

As used herein, a dsNA, e.g., DsiRNA or siRNA, having a sequence "sufficiently complementary" to a target RNA or cDNA sequence (e.g., glycolate oxidase (HAO1) mRNA) means that the dsNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsNA that is "sufficiently complementary" to a target RNA or cDNA sequence to trigger the destruction of the target RNA by the RNAi machinery or process can be identified as a dsNA that causes a detectable reduction in the level of the target RNA in an appropriate assay of dsNA activity (e.g., an in vitro assay as described in Example 2 below), or, in further examples, a dsNA that is sufficiently complementary to a target RNA or cDNA sequence to trigger the destruction of the target RNA by the RNAi machinery or process can be identified as a dsNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsNA activity. In additional examples, a dsNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsNA that is sufficiently complementary to a target RNA or cDNA sequence to trigger the destruction of the target RNA by the RNAi machinery or process can be identified as a dsNA capable of reducing target mRNA levels by at least 20% at least 48 hours post-administration of said dsNA to a cell or organism. Preferably, a dsNA that is sufficiently complementary to a target RNA or cDNA sequence to trigger the destruction of the target RNA by the RNAi machinery or process is identified as a dsNA capable of reducing target mRNA levels by at least 40% at least 72 hours post-administration of said dsNA to a cell or organism, by at least 40% at least four, five or seven days post-administration of said dsNA to a cell or organism, by at least 50% at least 48 hours post-administration of said dsNA to a cell or organism, by at least 50% at least 72 hours post-administration of said dsNA to a cell or organism, by at least 50% at least four, five or seven days post-administration of said dsNA to a cell or organism, by at least 80% at least 48 hours post-administration of said dsNA to a cell or organism, by at least 80% at least 72 hours post-administration of said dsNA to a cell or organism, or by at least 80% at least four, five or seven days post-administration of said dsNA to a cell or organism.

In certain embodiments, a nucleic acid of the invention (e.g., a DsiRNA or siRNA) possesses a sequence “sufficiently complementary to hybridize” to a target RNA or cDNA sequence, thereby achieving an inhibitory effect upon the target RNA. Hybridization, and conditions available for determining whether one nucleic acid is sufficiently complementary to another nucleic acid to allow the two sequences to hybridize, is described in greater detail below.

As will be clear to one of ordinary skill in the art, “sufficiently complementary” (contrasted with, e.g., “100% complementary”) allows for one or more mismatches to exist between a dsNA of the invention and the target RNA or cDNA sequence (e.g., glycolate oxidase (HAO1) mRNA), provided that the dsNA possesses complementarity sufficient to trigger the destruction of the target RNA by the RNAi machinery (e.g., the RISC complex) or process. In certain embodiments, a “sufficiently complementary” dsNA of the invention can harbor one, two, three or even four or more mismatches between the dsNA sequence and the target RNA or cDNA sequence (e.g., in certain such embodiments, the antisense strand of the dsRNA harbors one, two, three, four, five or even six or more mismatches when aligned with the target RNA or cDNA sequence for maximum complementarity). Additional consideration of the preferred location of such mismatches within certain dsRNAs of the instant invention is considered in greater detail below.

In one embodiment, dsRNA molecules of the invention that down regulate or reduce Glycolate Oxidase gene expression are used for treating, preventing or reducing Glycolate Oxidase-related diseases or disorders (e.g., PH1) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (Glycolate Oxidase) nucleic acid molecule. In certain embodiments, a DsiRNA molecule of the invention possesses a length of duplexed nucleotides between 25 and 66 nucleotides, optionally between 25 and 49 nucleotides in length (e.g., 25, 26, 27, 28, 29, 30, 31, 32, 33, 34, 35, 36, 37, 38, 39, 40, 41, 42, 43, 44, 45, 46, 47, 48 or 49, 50, 51, 52, 53, 54, 55, 56, 57, 58, 59, 60, 61, 62, 63, 64, 65, 66 nucleotides in length; optionally, all such nucleotides base pair with cognate nucleotides of the opposite strand). In related embodiments, a dsNA of the invention possesses strand lengths that are, independently, between 19 and 66 nucleotides in length, optionally between 25 and 53 nucleotides in length, e.g., 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49, 50, 51, 52, 53, 54, 55, 56, 57, 58, 59, 60, 61, 62, 63, 64, 65, 66 nucleotides in length. In certain embodiments, one strand length is 19-35 nucleotides in length, while the other strand length is 30-66 nucleotides in length and at least one strand has a 5' overhang of at least 5 nucleotides in length relative to the other strand. In certain related embodiments, the 3' end of the first strand and the 5' end of the second strand form a structure that is a blunt end or a 1-6 nucleotide 3' overhang, while the 5' end of the first strand forms a 5-35 nucleotide overhang with respect to the 3' end of the second strand. Optionally, between one and all nucleotides of the 5-35 nucleotide overhang are modified nucleotides (optionally, deoxyribonucleotides and/or modified ribonucleotides).

In some embodiments, a dsNA of the invention has a first or second strand that has at least 8 contiguous ribonucleotides. In certain embodiments, a dsNA of the invention has 9, 10, 11, 12, 13, 14, 15, 16, 17, 18, 19, 20, 21, 22, 23 or more (e.g., 24, 25, 26, 27, 28, 29, 30, 31, 32, 33, 34, 35, 26, or more, up to the full length of the strand) ribonucleotides, optionally including modified ribonucleotides (2'-O-methyl ribonucleotides, phosphorothioate linkages, etc.). In certain embodiments, the ribonucleotides or modified ribonucleotides are contiguous.

In certain embodiments of the invention, tetraloop- and modified nucleotide-containing dsNAs are contemplated as described, e.g., in US 2011/0288147. In certain such embodiments, a dsNA of the invention possesses a first strand and a second strand, where the first strand and the second strand form a duplex region of 19-25 nucleotides in length, wherein the first strand comprises a 3' region that extends beyond the first strand-second strand duplex region and comprises a tetraloop, and the dsNA comprises a discontinuity between the 3' terminus of the first strand and the 5' terminus of the second strand. Optionally, the discontinuity is positioned at a projected dicer cleavage site of the tetraloop-containing dsNA. It is contemplated that, as for any of the other dupexed oligonucleotides of the invention, tetraloop-containing duplexes of the invention can possess any range of modifications disclosed herein or otherwise known in the art, including, e.g., 2'-O-methyl, 2'-fluoro, inverter basic, GalNAc moieties, etc.

In certain embodiments, a dsNA comprising a first strand and a second strand, each strand, independently, having a 5' terminus and a 3' terminus, and having, independently, respective strand lengths of 25-53 nucleotides in length, is sufficiently highly modified (e.g., at least 10% or more, at least 20% or more, at least 30% or more, at least 40% or more, at least 50% or more, at least 60% or more, at least 70% or more, at least 80% or more, at least 90% or more, at least 95% or more residues of one and/or both strands are modified such that dicer cleavage of the dsNA is prevented (optionally, modified residues occur at and/or flanking one or all predicted dicer cleavage sites of the dsNA). Such non-dicer-cleaved dsNAs retain glycolate oxidase (HAO1) inhibition activity and are optionally cleaved by non-dicer nucleases to yield, e.g., 15-30, or in particular embodiments, 19-23 nucleotide strand length dsNAs capable of inhibiting glycolate oxidase (HAO1) in a mammalian cell. In certain related embodiments, dsNAs possessing sufficiently extensive modification to block dicer cleavage of such dsNAs optionally possess regions of unmodified nucleotide residues (e.g., one or two or more consecutive nucleotides, forming a "gap" or "window" in a modification pattern) that allow for and/or promote cleavage of such dsNAs by non-Dicer nucleases. In other embodiments, Dicer-cleaved dsNAs of the invention can include extensive modification patterns that possess such "windows" or "gaps" in modification such that Dicer cleavage preferentially occurs at such sites (as compared to heavily modified regions within such dsNAs).

In certain embodiments of the present invention, an oligonucleotide is provided (optionally, as a free antisense oligonucleotide or as an oligonucleotide of a double-stranded or other multiple-stranded structure) that includes a sequence complementary to the HAO1 target as described elsewhere herein and that is 15 to 80 nucleotides in length, e.g., in specific embodiments 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79 or 80 nucleotides in length.

In certain additional embodiments of the present invention, each oligonucleotide of a DsiRNA molecule of the invention is independently 25 to 53 nucleotides in length, in specific embodiments 25, 26, 27, 28, 29, 30, 31, 32, 33, 34, 35, 36, 37, 38, 39, 40, 41, 42, 43, 44, 45, 46, 47, 48, 49, 50, 51, 52 or 53 nucleotides in length. For DsiRNAs possessing a strand that exceeds 30 nucleotides in length, available structures include those where only one strand exceeds 30 nucleotides in length (see, e.g., U.S. Pat. No. 8,349,809), or those where both strands exceed 30 nucleotides in length (see, e.g., WO 2010/080129). Stabilizing modifications (e.g., 2'-O-Methyl, phosphorothioate, deoxyribonucleotides, including dNTP base pairs, 2'-F, etc.) can be incorporated within any double stranded nucleic acid of the invention, and can be used in particular, and optionally in abundance, especially within DsiRNAs possessing one or both strands exceeding 30 nucleotides in length. While the guide strand of a double stranded nucleic acid of the invention must possess a sequence of, e.g., 15, 16, 17, 18 or 19 nucleotides that are complementary to a target RNA (e.g., mRNA), additional sequence(s) of the guide strand need not be complementary to the target RNA. The end structures of double stranded nucleic acids possessing at least one strand length in excess of 30 nucleotides can also be varied while continuing to yield functional dsNAs—e.g. the 5' end of the guide strand and the 3' end of the passenger strand may form a 5'-overhang, a blunt end or a 3' overhang (for certain dsNAs, e.g., "single strand extended" dsNAs, the length of such a 5' or 3' overhang can be 1-4, 1-5, 1-6, 1-10, 1-15, 1-20 or even 1-25 or more nucleotides); similarly, the 3' end of the guide strand and the 5' end of the passenger strand may form a 5'-overhang, a blunt end or a 3' overhang (for certain dsNAs, e.g., "single strand extended" dsNAs, the length of such a 5' or 3' overhang can be 1-4, 1-5, 1-6, 1-10, 1-15, 1-20 or even 1-25 or more nucleotides). In certain embodiments, the 5' end of the passenger strand includes a 5'-overhang relative to the 3' end of the guide strand, such that a one to fifteen or more nucleotide single strand extension exists. Optionally, such single strand extensions of the dsNAs of the invention (whether present on the passenger or the guide strand) can be modified, e.g., with phosphorothioate (PS), 2'-F, 2'-O-methyl and/or other forms of modification contemplated herein or known in the art, including conjugation to, e.g., GalNAc moieties, inverted abasic residues, etc. In some embodiments, the guide strand of a single-strand extended duplex of the invention is between 35 and 50 nucleotides in length, while the duplex presents a single-strand extension that is seven to twenty nucleotides in length. In certain embodiments, the guide strand of a duplex is between 37 and 42 nucleotides in length and the duplex possesses a 5' single-stranded overhang of the passenger strand that is approximately five to fifteen single-stranded nucleotides in length (optionally, 6, 7, 8, 9, 10, 11, 12, 13, or 14 nucleotides in length). In related embodiments, the passenger strand of the duplex is about 25 to about 30 nucleotides in length. In certain embodiments, the extended region of the duplex can optionally be extensively modified, e.g., with one or more of 2'-O-methyl, 2'-Fluoro, GalNAc moieties, phosphorothioate internucleotide linkages, inverted abasic residues, etc. In certain embodiments, the length of the passenger strand is 31-49 nucleotides while the length of the guide strand is 31-53 nucleotides, optionally while the 5' end of the guide strand forms a blunt end (optionally, a base-paired blunt end) with the 3' end of the passenger strand, optionally, with the 3' end of the guide strand and the 5' end of the passenger strand forming a 3' overhang of 1-4 nucleotides in length. Exemplary "extended" Dicer substrate structures are set forth, e.g., in US 2010/01739748,513,207 and U.S. Pat. No. 8,349,809, both of which are incorporated herein by reference. In certain embodiments, one or more strands of the dsNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (Glycolate Oxidase) nucleic acid molecule. In certain embodiments, a DsiRNA molecule of the invention possesses a length of duplexed nucleotides between 25 and 49 nucleotides in length (e.g., 25, 26, 27, 28, 29, 30, 31, 32, 33, 34, 35, 36, 37, 38, 39, 40, 41, 42, 43, 44, 45, 46, 47, 48 or 49 nucleotides in length; optionally, all such nucleotides base pair with cognate nucleotides of the opposite strand).

In a further embodiment of the present invention, each oligonucleotide of a DsiRNA molecule of the invention is independently 19 to 66 nucleotides in length, in specific embodiments 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65 or 66 nucleotides in length. For dsNAs possessing a strand that exceeds 30 nucleotides in length, available structures include those where only one strand exceeds 30 nucleotides in length (see, e.g., U.S. Pat. No. 8,349,809, where an exemplary double stranded nucleic acid possesses a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand (or the second strand) is 25-30 nucleotide residues in length, where starting from the 5' terminal nucleotide (position 1) positions 1 to 23 of the first strand (or the second strand) include at least 8 ribonucleotides; the second strand (or the first strand) is 36-66 nucleotide residues in length and, starting from the 3' terminal nucleotide, includes at least 8 ribonucleotides in the positions paired with positions 1-23 of the first strand to form a duplex; where at least the 3' terminal nucleotide of the second strand (or the first strand) is unpaired with the first strand (or the second strand), and up to 6 consecutive 3' terminal nucleotides are unpaired with the first strand (or the second strand), thereby forming a 3' single stranded overhang of 1-6 nucleotides; where the 5' terminus of the second strand (or the first strand) includes from 10-30 consecutive nucleotides which are unpaired with the first strand (or the second strand), thereby forming a 10-30 nucleotide single stranded 5' overhang; where at least the first strand (or the second strand) 5' terminal and 3' terminal nucleotides are base paired with nucleotides of the second strand (or first strand) when the first and second strands are aligned for maximum complementarity, thereby forming a substantially duplexed region between the first and second strands; and the second strand is sufficiently complementary to a target RNA along at least 19 ribonucleotides of the second strand length to reduce target gene expression when the double stranded nucleic acid is introduced into a mammalian cell), or those where both strands exceed 30 nucleotides in length (see, e.g., U.S. Pat. No. 8,513,207, where an exemplary double stranded nucleic acid (dsNA) possesses a first oligonucleotide strand having a 5' terminus and a 3' terminus and a second oligonucleotide strand having a 5' terminus and a 3' terminus, where the first strand is 31 to 49 nucleotide residues in length, where starting from the first nucleotide (position 1) at the 5' terminus of the first strand, positions 1 to 23 of the first strand are ribonucleotides; the second strand is 31 to 53 nucleotide residues in length and includes 23 consecutive ribonucleotides that base pair with the ribonucleotides of positions 1 to 23 of the first strand to form a duplex; the 5' terminus of the first strand and the 3' terminus of said second strand form a blunt end or a 1-4 nucleotide 3' overhang; the 3' terminus of the first strand and the 5' terminus of said second strand form a duplexed blunt end, a 5' overhang or a 3' overhang; optionally, at least one of positions 24 to the 3' terminal nucleotide residue of the first strand is a deoxyribonucleotide, optionally, that base pairs with a deoxyribonucleotide of said second strand; and the second strand is sufficiently complementary to a target RNA along at least 19 ribonucleotides of the second strand length to reduce target gene expression when the double stranded nucleic acid is introduced into a mammalian cell).

In certain embodiments, an active dsNA of the invention can possess a 5' overhang of the first strand (optionally, the passenger strand) with respect to the second strand (optionally, the guide strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 5' overhang "extended" region of the first strand is optionally modified at one or more residues (optionally, at alternating residues, all residues, or any other selection of residues).

In certain embodiments, an active dsNA of the invention can possess a 3' overhang of the first strand (optionally, the passenger strand) with respect to the second strand (optionally, the guide strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 3' overhang "extended" region of the first strand is optionally modified at one or more residues (optionally, at alternating residues, all residues, or any other selection of residues).

In additional embodiments, an active dsNA of the invention can possess a 5' overhang of the second strand (optionally, the guide strand) with respect to the first strand (optionally, the passenger strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 5' overhang "extended" region of the second strand is optionally modified at one or more residues (optionally, at alternating residues, all residues, or any other selection of residues).

In further embodiments, an active dsNA of the invention can possess a 3' overhang of the second strand (optionally, the guide strand) with respect to the first strand (optionally, the passenger strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 3' overhang "extended" region of the second strand is optionally modified at one or more residues (optionally, at alternating residues, all residues, or any other selection of residues).

In another embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (HAO1) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below.)

In certain embodiments, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of a nucleic acid of the instant invention are modified residues. For a dsNA of the invention, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of the first strand are modified residues. Additionally and/or alternatively for a dsNA of the invention, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of the second strand are modified residues. For the dsNAs of the invention, modifications of both duplex (double-stranded) regions and overhang (single-stranded) regions are contemplated. Thus, in certain embodiments, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more (e.g., all) duplex nucleotide residues are modified residues. Additionally and/or alternatively, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more (e.g., all) overhang nucleotide residues of one or both strands are modified residues. Optionally, the modifications of the dsNAs of the invention do not include an inverted abasic (e.g., inverted deoxy abasic) or inverted dT end-protecting group. Alternatively, a dsNA of the invention includes a terminal cap moiety (e.g., an inverted deoxy abasic and/or inverted dT end-protecting group). Optionally, such a terminal cap moiety is located at the 5' end, at the 3' end, or at both the 5' end and the 3' end of the first strand, of the second strand, or of both first and second strands.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more isolated dsRNA molecules of the present disclosure. In particular aspects, a cell processes dsRNAs or dsRNA-containing molecules resulting in RNA interference of target nucleic acids, and contains proteins and protein complexes required for RNAi, e.g., Dicer and RISC.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an $IC_{50}$ curve via assessment of the inhibitory activity of DsiRNAs and non-DsiRNAs across a range of effective concentrations is a preferred method for detecting the enhanced potency of a DsiRNA relative to a non-DsiRNA inhibitory agent.

In certain embodiments, a DsiRNA (in a state as initially formed, prior to dicer cleavage) is more potent at reducing Glycolate Oxidase target gene expression in a mammalian cell than a 19, 20, 21, 22 or 23 base pair sequence that is contained within it. In certain such embodiments, a DsiRNA prior to dicer cleavage is more potent than a 19-21mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23mer siRNA (e.g., a 19 base pair duplex with dTdT overhangs) that targets at least 19 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23mer siRNA that targets at least 20 nucleotides of the 21 nucleotide target sequence that is recited for a DsiRNA of the invention. Optionally, the DsiRNA is more potent than a 19-23mer siRNA that targets the same 21 nucleotide target sequence that is recited for a DsiRNA of the invention. In certain embodiments, the DsiRNA is more potent than any 21mer siRNA that targets the same 21 nucleotide target sequence that is recited for a DsiRNA of the invention. Optionally, the DsiRNA is more potent than any 21 or 22mer siRNA that targets the same 21 nucleotide target sequence that is recited for a DsiRNA of the invention. In certain embodiments, the DsiRNA is more potent than any 21, 22 or 23mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an $IC_{50}$ assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more dsRNA molecules of this invention. The one or more dsRNA molecules can independently be targeted to the same or different sites.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the dsRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the dsRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Various methodologies of the instant invention include step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a dsRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Structures of Anti-Glycolate Oxidase DsiRNA Agents

In certain embodiments, the anti-Glycolate Oxidase DsiRNA agents of the invention can have the following structures:

In one such embodiment, the DsiRNA comprises:

```
5'-XXXXXXXXXXXXXXXXXXXXXXXXX-3'

3'-YXXXXXXXXXXXXXXXXXXXXXXXXX-5'
```

wherein "X"=RNA and "Y" is an overhang domain comprised of 1-4 RNA monomers that are optionally 2'-O-methyl RNA monomers. In a related embodiment, the DsiRNA comprises:

```
5'-XXXXXXXXXXXXXXXXXXXXXXXDD-3'

3'-YXXXXXXXXXXXXXXXXXXXXXXXXXX-5'
```

wherein "X"=RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

```
5'-XXXXXXXXXXXXXXXXXXXXXXXXX-3'

3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'

3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

```
5'-XXXXXXXXXXXXXXXXXXXXXXXXX-3'

3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'

3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

```
5'-XXXXXXXXXXXXXXXXXXXXXXXXX-3'

3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'

3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

```
5'-XXXXXXXXXXXXXXXXXXXXXXXXX-3'

3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'

3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M7" or "M7" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
```

wherein “X”=RNA, “X”=2'-O-methyl RNA, “Y” is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'
3'-YXXXXXXXXXXXXXXXXXXXXXXXXX-5'
```

wherein “X”=RNA, “X”=2'-O-methyl RNA, “Y” is an overhang domain comprised of 1-4 RNA monomers that are optionally 2'-O-methyl RNA monomers, underlined residues are 2'-O-methyl RNA monomers, and “D”=DNA. The top strand is the sense strand, and the bottom strand is the antisense strand. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
```

wherein “X”=RNA and “X”, 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein “X”=RNA, “X”=2'-O-methyl RNA, and “D”=DNA. The top strand is the sense strand, and the bottom strand is the antisense strand. This modification pattern is also referred to herein as the “AS-M6” or “M6” modification pattern.

In other embodiments, the DsiRNA comprises:

```
5'-XXXXXXXXXXXXXXXXXXXXXXXXX-3'
3'-YXXXXXXXXXXXXXXXXXXXXXXXXX-5'
```

wherein “X”=RNA, “X”=2'-O-methyl RNA, “Y” is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXX-5'
```

wherein “X”=RNA, “X”=2'-O-methyl RNA, “Y” is an overhang domain comprised of 1-4 RNA monomers that are optionally 2'-O-methyl RNA monomers, underlined residues are 2'-O-methyl RNA monomers, and “D”=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXXX-5'
```

wherein “X”=RNA and “X”, 2'-O-methyl RNA. The top strand is the sense strand, and the bottom strand is the antisense strand. In another related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein “X”=RNA, “X”=2'-O-methyl RNA, and “D”=DNA. The top strand is the sense strand, and the bottom strand is the antisense strand. This modification pattern is also referred to herein as the “AS-M5” or “M5” modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
```

wherein “X”=RNA, “X”=2'-O-methyl RNA, “Y” is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXX-5'
```

wherein “X”=RNA, “X”=2'-O-methyl RNA, “Y” is an overhang domain comprised of 1-4 RNA monomers that are optionally 2'-O-methyl RNA monomers, underlined residues are 2'-O-methyl RNA monomers, and “D”=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXXX-5'
```

wherein “X”=RNA and “X”, 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein “X”=RNA, “X”=2'-O-methyl RNA, and “D”=DNA. The top strand is the sense strand, and the bottom strand is the antisense strand. This modification pattern is also referred to herein as the “AS-M4” or “M4” modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
```

wherein “X”=RNA, “X”=2'-O-methyl RNA, “Y” is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M8" or "M8" modification pattern.

In other embodiments, the DsiRNA comprises:

```
5'-XXXXXXXXXXXXXXXXXXXXXXXXX-3'
3'-YXXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M3" or "M3" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M2" or "M2" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

5'-XXXXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXXXX-3'

3'-XXXXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M1" or "M1" modification pattern.

In additional embodiments, the DsiRNA comprises:

5'-XXXXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXXXX-3'

3'-XXXXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M9" or "M9" modification pattern.

In other embodiments, the DsiRNA comprises:

5'-XXXXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

5'-XXXXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXXXX-3'

3'-XXXXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M10" or "M10" modification pattern.

In further embodiments, the DsiRNA comprises:

5'-XXXXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M11" or "M11" modification pattern.

In additional embodiments, the DsiRNA comprises:

5'-XXXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M12" or "M12" modification pattern.

In further embodiments, the DsiRNA comprises:

5'-XXXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M13" or "M13" modification pattern.

In other embodiments, the DsiRNA comprises:

5'-XXXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M21" or "M21" modification pattern.

In further embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M14" or "M14" modification pattern.

In additional embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M15" or "M15" modification pattern.

In further embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M16" or "M16" modification pattern.

In additional embodiments, the DsiRNA comprises:

```
5'-XXXXXXXXXXXXXXXXXXXXXXXXXXX-3'

3'-YXXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M17" or "M17" modification pattern.

In further embodiments, the DsiRNA comprises:

```
5'-XXXXXXXXXXXXXXXXXXXXXXXXXXX-3'

3'-YXXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M18" or "M18" modification pattern.

In additional embodiments, the DsiRNA comprises:

```
5'-XXXXXXXXXXXXXXXXXXXXXXXXXXX-3'

3'-YXXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M19" or "M19" modification pattern.

In further embodiments, the DsiRNA comprises:

```
5'-XXXXXXXXXXXXXXXXXXXXXXXXX-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M20" or "M20" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M22" or "M22" modification pattern.

In further embodiments, the DsiRNA comprises:

```
5'-XXXXXXXXXXXXXXXXXXXXXXXXX-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M24" or "M24" modification pattern.

In additional embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M25" or "M25" modification pattern.

In further embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M26" or "M26" modification pattern.

In additional embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M27" or "M27" modification pattern.

In further embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M28" or "M28" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M29" or "M29" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M30" or "M30" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M31" or "M31" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M32" or "M32" modification pattern.

In further embodiments, the DsiRNA comprises:

```
5'-XXXXXXXXXXXXXXXXXXXXXXXXX-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M34" or "M34" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M35" or "M35" modification pattern.

In further embodiments, the DsiRNA comprises:

```
5'-XXXXXXXXXXXXXXXXXXXXXXXXX-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M37" or "M37" modification pattern.

In additional embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M38" or "M38" modification pattern.

In further embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M40" or "M40" modification pattern.

In additional embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M41" or "M41" modification pattern.

In further embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXXXX-3'

3'-XXXXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M36" or "M36" modification pattern.

In additional embodiments, the DsiRNA comprises:

5'-XXXXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXXXX-3'

3'-XXXXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M42" or "M42" modification pattern.

In further embodiments, the DsiRNA comprises:

5'-XXXXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXXXX-3'

3'-XXXXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M43" or "M43" modification pattern.

In additional embodiments, the DsiRNA comprises:

5'-XXXXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M44" or "M44" modification pattern.

In further embodiments, the DsiRNA comprises:

```
5'-XXXXXXXXXXXXXXXXXXXXXXXXXXX-3'
3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M45" or "M45" modification pattern.

In additional embodiments, the DsiRNA comprises:

```
5'-XXXXXXXXXXXXXXXXXXXXXXXXXXX-3'
3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M46" or "M46" modification pattern.

In further embodiments, the DsiRNA comprises:

```
5'-XXXXXXXXXXXXXXXXXXXXXXXXXXX-3'
3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M47" or "M47" modification pattern.

In additional embodiments, the DsiRNA comprises:

5'-XXXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M48" or "M48" modification pattern.

In further embodiments, the DsiRNA comprises:

5'-XXXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M52" or "M52" modification pattern.

In further embodiments, the DsiRNA comprises:

5'-XXXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M54" or "M54" modification pattern.

In additional embodiments, the DsiRNA comprises:

5'-XXXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M55" or "M55" modification pattern.

In further embodiments, the DsiRNA comprises:

5'-XXXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M56" or "M56" modification pattern.

In additional embodiments, the DsiRNA comprises:

5'-XXXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M57" or "M57" modification pattern.

In further embodiments, the DsiRNA comprises:

5'-XXXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M58" or "M58" modification pattern.

In additional embodiments, the DsiRNA comprises:

5'-XXXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M59" or "M59" modification pattern.

In further embodiments, the DsiRNA comprises:

5'-XXXXXXXXXXXXXXXXXXXXXXXXX-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "<u>X</u>"=2'-O-methyl RNA, and "D"=DNA. The top strand is the sense strand, and the bottom strand is the antisense strand. This modification pattern is also referred to herein as the "AS-M60" or "M60" modification pattern.

In additional embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "<u>X</u>", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "<u>X</u>"=2'-O-methyl RNA, and "D"=DNA. The top strand is the sense strand, and the bottom strand is the antisense strand. This modification pattern is also referred to herein as the "AS-M61" or "M61" modification pattern.

In further embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "<u>X</u>", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "<u>X</u>"=2'-O-methyl RNA, and "D"=DNA. The top strand is the sense strand, and the bottom strand is the antisense strand. This modification pattern is also referred to herein as the "AS-M62" or "M62" modification pattern.

In additional embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "<u>X</u>", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M63" or "M63" modification pattern.

In further embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M64" or "M64" modification pattern.

In additional embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M65" or "M65" modification pattern.

In further embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M66" or "M66" modification pattern.

In additional embodiments, the DsiRNA comprises:

5'-XXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M67" or "M67" modification pattern.

In further embodiments, the DsiRNA comprises:

5'-XXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M68" or "M68" modification pattern.

In additional embodiments, the DsiRNA comprises:

5'-XXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M69" or "M69" modification pattern.

In further embodiments, the DsiRNA comprises:

5'-XXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M70" or "M70" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M71" or "M71" modification pattern.

In further embodiments, the DsiRNA comprises:

```
5'-XXXXXXXXXXXXXXXXXXXXXXXXX-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M72" or "M72" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M73" or "M73" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M7*" or "M7*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M6*" or "M6*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In another related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M5*" or "M5*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M4*" or "M4*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M8*" or "M8*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M2*" or "M2*" modification pattern.

In other embodiments, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M10*" or "M10*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M11*" or "M11*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M13*" or "M13*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M14*" or "M14*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M15*" or "M15*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M16*" or "M16*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M17*" or "M17*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M18*" or "M18*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M19*" or "M19*" modification pattern.

In further embodiments, the DsiRNA comprises:

```
5'-XXXXXXXXXXXXXXXXXXXXXXXDD-3'

3'-YXXXXXXXXXXXXXXXXXXXXXXXXXX-5'
```

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M20*" or "M20*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M22*" or "M22*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M24*" or "M24*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M25*" or "M25*" modification pattern.

In further embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M26*" or "M26*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M27*" or "M27*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M28*" or "M28*" modification pattern.

In further embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M29*" or "M29*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M34*" or "M34*" modification pattern.

In further embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M35*" or "M35*" modification pattern.

In additional embodiments, the DsiRNA comprises:

```
5'-XXXXXXXXXXXXXXXXXXXXXXXXXXX-3'
3'-XXXXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M37*" or "M37*" modification pattern.

In further embodiments, the DsiRNA comprises:

```
5'-XXXXXXXXXXXXXXXXXXXXXXXXXXX-3'
3'-XXXXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M38*" or "M38*" modification pattern.

In further embodiments, the DsiRNA comprises:

```
5'-XXXXXXXXXXXXXXXXXXXXXXXXXXX-3'
3'-XXXXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M40*" or "M40*" modification pattern.

In additional embodiments, the DsiRNA comprises:

```
5'-XXXXXXXXXXXXXXXXXXXXXXXXXXX-3'
3'-XXXXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M41*" or "M41*" modification pattern.

In further embodiments, the DsiRNA comprises:

```
5'-XXXXXXXXXXXXXXXXXXXXXXXXXXX-3'
3'-XXXXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M36*" or "M36*" modification pattern.

In additional embodiments, the DsiRNA comprises:

```
5'-XXXXXXXXXXXXXXXXXXXXXXXXXXX-3'
3'-XXXXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M42*" or "M42*" modification pattern.

In further embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M43*" or "M43*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M44*" or "M44*" modification pattern.

In further embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M46*" or "M46*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M47*" or "M47*" modification pattern.

In further embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M48*" or "M48*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M52*" or "M52*" modification pattern.

In further embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M54*" or "M54*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M55*" or "M55*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M56*" or "M56*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M57*" or "M57*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M58*" or "M58*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M59*" or "M59*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M60*" or "M60*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M61*" or "M61*" modification pattern.

In further embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M62*" or "M62*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M63*" or "M63*" modification pattern.

In further embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M64*" or "M64*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M65*" or "M65*" modification pattern.

In further embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M66*" or "M66*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X", 2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M67*" or "M67*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M68*" or "M68*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M69*" or "M69*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M70*" or "M70*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M71*" or "M71*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M72*" or "M72*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
```

wherein "X"=RNA and "X", 2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
```

wherein "X"=RNA, "X"=2'-O-methyl RNA, and "D"=DNA. The top strand is the sense strand, and the bottom strand is the antisense strand. This modification pattern is also referred to herein as the "AS-M73*" or "M73*" modification pattern.

Additional exemplary antisense strand modifications include the following:

```
3'-XXXXXXXXXXXXXXXXXXXXXXXXXXX-5' "AS-M74"
3'-XXXXXXXXXXXXXXXXXXXXXXXXXXX-5' "AS-M75"
3'-XXXXXXXXXXXXXXXXXXXXXXXXXXX-5' "AS-M76"
3'-XXXXXXXXXXXXXXXXXXXXXXXXXXX-5' "AS-M77"
3'-XXXXXXXXXXXXXXXXXXXXXXXXXXX-5' "AS-M78"
```

-continued

3'-XXXXXXXXXXXXXXXXXXXXXXXXXX-5' "AS-M79"

3'-XXXXXXXXXXXXXXXXXXXXXXXXXX-5' "AS-M80"

3'-XXXXXXXXXXXXXXXXXXXXXXXXXX-5' "AS-M8"

3'-XpXXXXXXXXXXXXXXXXXXXXXXXXXX-5' "AS-M82"

3'-XpXXXXXXXXXXXXXXXXXXXXXXXXXX-5' "AS-M83"

3'-XXXXXXXXXXXXXXXXXXXXXXXXXX-5' "AS-M84"

3'-XXXXXXXXXXXXXXXXXXXXXXXXXX-5' "AS-M85"

3'-FFFXXXXXXXXXXXXXXXXXXXFFFF-5' "AS-M88"

3'-XXXXFXXXFXFXXXXXXXXXXXXXXX-5' "AS-M89"

3'-FFFXFXFXFXFXFXFXFXXXXXXFFFF-5' "AS-M90"

3'-FFFXXXXXXXXXXXXXXXXXXXXXFF-5' "AS-M91"

3'-XXXXXXFXXXXXFXFXXXXXXXXXXXX-5' "AS-M92"

3'-FFFXFXXXXXXXXXXXXFXXXXXXXXX-5' "AS-M93"

3'-FFFXFXFXXXXXFXFXFXFXXXXFFFF-5' "AS-M94"

3'-FFFXFXFXFXFXFXFXFXXXXXXFFFF-5' "AS-M95"

3'-FFFXFXFXFXFXFXFXFXXXXXXFFFpF-5' "AS-M96"

3'-XXXXXXXXXXXXXXXXXXXXXXXXXX-5' "AS-M210"

3'-XXXXXXXXXXXXXXXXXXXXXXXXXX-5' "AS-M74*"

3'-XXXXXXXXXXXXXXXXXXXXXXXXXX-5' "AS-M75*"

3'-XXXXXXXXXXXXXXXXXXXXXXXXXX-5' "AS-M76*"

3'-XXXXXXXXXXXXXXXXXXXXXXXXXX-5' "AS-M77*"

3'-XXXXXXXXXXXXXXXXXXXXXXXXXX-5' "AS-M78*"

3'-XXXXXXXXXXXXXXXXXXXXXXXXXX-5' "AS-M79*"

3'-XXXXXXXXXXXXXXXXXXXXXXXXXX-5' "AS-M80*"

3'-XpXXXXXXXXXXXXXXXXXXXXXXXXXX-5' "AS-M82*"

3'-XpXXXXXXXXXXXXXXXXXXXXXXXXXX-5' "AS-M83*"

3'-XXXXXXXXXXXXXXXXXXXXXXXXXX-5' "AS-M84*"

3'-XFFXXXXXXXXXXXXXXXXXXXFFFF-5' "AS-M88*"

3'-XXXXFXXXFXFXXXXXXXXXXXXXXX-5' "AS-M89*"

3'-XFFXFXFXFXFXFXFXFXXXXXXFFFF-5' "AS-M90*"

3'-XFFXXXXXXXXXXXXXXXXXXXXXFF-5' "AS-M91*"

3'-XXXXXXFXXXXXFXFXXXXXXXXXXXX-5' "AS-M92*"

3'-XFFXFXXXXXXXXXXXXFXXXXXXXXX-5' "AS-M93*"

3'-XFFXFXFXXXXXFXFXFXFXXXXFFFF-5' "AS-M94*"

3'-XFFXFXFXFXFXFXFXFXXXXXXFFFF-5' "AS-M95*"

3'-XFFXFXFXFXFXFXFXFXXXXXXFFFpF-5' "AS-M96*"

3'-XXXXXXXXXXXXXXXXXXXXXXXXXX-5' "AS-M210*"

3'-XpXXXXXXXXXXXXXXXXXXXXXXXXXpX-5' "AS-M101"

3'-XpXXXXXXXXXXXXXXXXXXXXXXXXXpX-5' "AS-M104"

3'-XpXXXXXXXXXXXXXXXXXXXXXXXXXpX-5' "AS-M104*"

3'-XpFpXFXFXFXFXFXFXFXFXFFXXXpX-5' "AS-M105"

3'-XpFpXFXFXFXFXFXFXFXFXFFXXXpX-5' "AS-M105*"

3'-XpXXXXXXXXXXXXXXXXXXXXXXXXXpX-5' "AS-M106"

3'-XpXXXXXXXXXXXXXXXXXXXXXXXXXpX-5' "AS-M106*"

3'-XXpXXXXXXXXXXXXXXXXXXXXXXXXX-5' "AS-M107"

3'-XXpXXXXXXXXXXXXXXXXXXXXXXXXX-5' "AS-M107*"

3'-ba-XXXXXXXXXXXXXXXXXXXXXXXXXX-5' "AS-M108"
(ba = inverted abasic for F7
stabilization at 3' end)

3'-ba-XXXXXXXXXXXXXXXXXXXXXXXXXX-5' "AS-M108*"
(ba = inverted abasic for F7
stabilization at 3' end)

3'-XDXXXXXXXXXXXXXXXXXXXXXXXX-5' "AS-M109"

3'-XpXXFXFXFXXXXXXXXXXXXXXXXXpX-5' "AS-M110"

3'-XpXXFXFXFXXXXXXXXXXXXXXXXXpX-5' "AS-M110*"

3'-XpXXFXFXFXXXXXFXFXFXFXXXXXXpX-5' "AS-M111"

3'-XpXXFXFXFFXXXXXXXXXXFXXXXXXpX-5' "AS-M112"

3'-XpXXFXFXFFXXFXXXXXXFXXXXXXpX-5' "AS-M113"

3'-XpXXFXFXFFFFFXXXXXXFXXXXXXpX-5' "AS-M114"

3'-XpXXFXFXFFFFFXXXXXXFXXFXXXpX-5' "AS-M115"

3'-XpXXFXFXFFFFFXXXXXXFFFFXXXpX-5' "AS-M116"

3'-XpFXFXFXFXFXFXFXFXFXFXFXFpX-5' "AS-M117"

3'-XpXXFXFXFXXXXXFXFXFXFXXXXXXpX-5' "AS-M111*"

3'-XpXXFXFXFFXXXXXXXXXXFXXXXXXpX-5' "AS-M112*"

3'-XpXXFXFXFFXXFXXXXXXFXXXXXXpX-5' "AS-M113*"

3'-XpXXFXFXFFFFFXXXXXXFXXXXXXpX-5' "AS-M114*"

3'-XpXXFXFXFFFFFXXXXXXFXXFXXXpX-5' "AS-M115*"

3'-XpXXFXFXFFFFFXXXXXXFFFFXXXpX-5' "AS-M116*"

3'-XpFXFXFXFXFXFXFXFXFXFXFXFpX-5' "AS-M117*"

3'-XpXXXXXXXXXXXXXXXXXXXXXXXXXpX-5' "AS-M120"

3'-XpXXXXXXXXXXXXXXXXXXXXXXXXXpX-5' "AS-M121"

3'-XpXXXXXXXXXXXXXXXXXXXXXXXXXpX-5' "AS-M122"

3'-XpXXXXXXXXXXXXXXXXXXXXXXXXXpX-5' "AS-M123"

3'-XpXXXXXXXXXXXXXXXXXXXXXXXXXpX-5' "AS-M124"

3'-XpXXXXXXXXXXXXXXXXXXXXXXXXXpX-5' "AS-M125"

3'-XpFpXFXFXFXXXXXFXFXFXXXXFXFpX-5' "AS-M126"

3'-XpFpXFXFXFXXXXXFXFXFXXXXFXFpX-5' "AS-M127"

3'-XpFpXFXFXFXFXFXFXFXFXFFXXXpX-5' "AS-M128"

3'-XpFpXFXFXFXFXFXFXFXFXFFFFFpF-5' "AS-M129"

3'-XpFpXFXFXFXFXFXFXFXFXXXXFXFpX-5' "AS-M130"

3'-XpFpXFXFXFXFXFXFXFXFXFXFXFpX-5' "AS-M131"

3'-XpFpXFXFXFXFXFXFXFXFXFXXXXpX-5' "AS-M132"

3'-XpFpXFXFXFXFXFXFXFXFXFXXXXpX-5' "AS-M133"

-continued

3'-XpFpXFXFXFXFXFXFXFXFXFXFXFFFpF-5' "AS-M134"

3'-XXXXXXXXXXXXXXXXXXXXXXXXXXX-5' "AS-M135"

3'-XXXXXXXXXXXXXXXXXXXXXXXXXXX-5' "AS-M136"

3'-XXXXXXXXXXXXXXXXXXXXXXXXXXX-5' "AS-M137"

3'-XXXFXFXFXXXXXFXFXFXFXXXXXXX-5' "AS-M138"

3'-XXXFXFXFFXXXXXXXXXXFXXXXXXX-5' "AS-M139"

3'-XpXXFXFXFXXXXXFXFXFFFXXXXXXpX-5' "AS-M140"

3'-XpXXFXFXFFXXXFFXFXFFFXXXXXXpX-5' "AS-M141"

3'-XpXXFXFXFXFXFXFXFXFFFXXXXXXpX-5' "AS-M142"

3'-XpXXFXFXFFFFFFFXFXFFFXXXXXXpX-5' "AS-M143"

3'-XpXXFXFXFXFXFXFXFXFpXpFpXXXXXXpX-5' "AS-M144"

3'-XXXXXXXXXXXXXXXXFXXXXXXXXXX-5' "AS-M145"

3'-XXXXXXXXXXXXXXFXXXXXXXXXXXX-5' "AS-M146"

3'-XXXXXXFXXXXXXXXXXXXXXXXXXXX-5' "AS-M147"

3'-XXXXXXXXXXFXXXXXXXXXXXXXXXX-5' "AS-M148"

3'-XXXXXXXXXXXXFXXXXXXXXXXXXXX-5' "AS-M149"

3'-XXXXXXXXXXFXFXXXXXXXXXXXXXX-5' "AS-M150"

3'-XXXXXXXXXXXXFXXXFXXXXXXXXXX-5' "AS-M151"

3'-XXXXXXXXXXFXXXFXXXXXXXXXXXX-5' "AS-M152"

3'-XXXXXXXXFXXXXXXXXXXXXXXXXXX-5' "AS-M153"

3'-XXXXXXXXFXXXXXXXXXXXXXXXXXX-5' "AS-M154"

3'-XXXXXXFXXXXXXXXXXXXXXXXXXXX-5' "AS-M155"

3'-XpXXXXXXXXXXXXXXXXXXXXXXXXXpX-5' "AS-M156"

3'-XpXXXXXXXXXXXXXXXXXXXXXXXXXpX-5' "AS-M157"

3'-XpXXFXFFFFXXXFXXFXXFFXXXXXXpX-5' "AS-M158"

3'-XpXXFXFFFFFFFFXXFXXFFXXXXXXpX-5' "AS-M159"

3'-XpXXFXXXFXXXXXFXFXXFFXXXXXXpX-5' "AS-M160"

3'-XpXXFXXXFXFXFXFXFXXFFXXXXXXpX-5' "AS-M161"

3'-XXXXXXXXFXFXFXXXXXXXXXXXXXX-5' "AS-M162"

3'-XXXXXXXXXXXXXXXXXXXXXXXXXXX-5' "AS-M163"

3'-XXXXXXXXDXXXXXXXXXXXXXXXXXX-5' "AS-M164"

3'-XpXXXXXXXXXXXXXXXXXXXXXXXXXpX-5' "AS-M120*"

3'-XpXXXXXXXXXXXXXXXXXXXXXXXXXpX-5' "AS-M121*"

3'-XpXXXXXXXXXXXXXXXXXXXXXXXXXpX-5' "AS-M122*"

3'-XpXXXXXXXXXXXXXXXXXXXXXXXXXpX-5' "AS-M123*"

3'-XpXXXXXXXXXXXXXXXXXXXXXXXXXpX-5' "AS-M124*"

3'-XpXXXXXXXXXXXXXXXXXXXXXXXXXpX-5' "AS-M125*"

3'-XpFpXFXFXFXXXXXFXFXFXFXXXFXFpX-5' "AS-M126*"

3'-XpFpXFXFXFXXXXXFXFXFXFXXXFXFpX-5' "AS-M127*"

3'-XpFpXFXFXFXFXFXFXFXFXFXFFXXXpX-5' "AS-M128*"

3'-XpFpXFXFXFXFXFXFXFXFXFXFFFFFpF-5' "AS-M129*"

-continued

3'-XpFpXFXFXFXFXFXFXFXFXFXXXFXFpX-5' "AS-M130*"

3'-XpFpXFXFXFXFXFXFXFXFXFXFXFXFpX-5' "AS-M131*"

3'-XpFpXFXFXFXFXFXFXFXFXFXFXXXXpX-5' "AS-M132*"

3'-XpFpXFXFXFXFXFXFXFXFXFXFXXXXpX-5' "AS-M133*"

3'-XpFpXFXFXFXFXFXFXFXFXFXFXFFFpF-5' "AS-M134*"

3'-XXXXXXXXXXXXXXXXXXXXXXXXXXX-5' "AS-M135*"

3'-XXXXXXXXXXXXXXXXXXXXXXXXXXX-5' "AS-M136*"

3'-XXXXXXXXXXXXXXXXXXXXXXXXXXX-5' "AS-M137*"

3'-XXXFXFXFXXXXXFXFXFXFXXXXXXX-5' "AS-M138*"

3'-XXXFXFXFFXXXXXXXXXXFXXXXXXX-5' "AS-M139*"

3'-XpXXFXFXFXXXXXFXFXFFFXXXXXXpX-5' "AS-M140*"

3'-XpXXFXFXFFXXXFFXFXFFFXXXXXXpX-5' "AS-M141*"

3'-XpXXFXFXFXFXFXFXFXFFFXXXXXXpX-5' "AS-M142*"

3'-XpXXFXFXFFFFFFFXFXFFFXXXXXXpX-5' "AS-M143*"

3'-XpXXFXFXFXFXFXFXFXFpXpFpXXXXXXpX-5' "AS-M144*"

3'-XXXXXXXXXXXXXXXXFXXXXXXXXXX-5' "AS-M145*"

3'-XXXXXXXXXXXXXXFXXXXXXXXXXXX-5' "AS-M146*"

3'-XXXXXXFXXXXXXXXXXXXXXXXXXXX-5' "AS-M147*"

3'-XXXXXXXXXXFXXXXXXXXXXXXXXXX-5' "AS-M148*"

3'-XXXXXXXXXXXXFXXXXXXXXXXXXXX-5' "AS-M149*"

3'-XXXXXXXXXXFXFXXXXXXXXXXXXXX-5' "AS-M150*"

3'-XXXXXXXXXXXXFXXXFXXXXXXXXXX-5' "AS-M151*"

3'-XXXXXXXXXXFXXXFXXXXXXXXXXXX-5' "AS-M152*"

3'-XXXXXXXXFXXXXXXXXXXXXXXXXXX-5' "AS-M153*"

3'-XXXXXXXXFXXXXXXXXXXXXXXXXXX-5' "AS-M154*"

3'-XXXXXXFXXXXXXXXXXXXXXXXXXXX-5' "AS-M155*"

3'-XpXXXXXXXXXXXXXXXXXXXXXXXXXpX-5' "AS-M156*"

3'-XpXXXXXXXXXXXXXXXXXXXXXXXXXpX-5' "AS-M157*"

3'-XpXXFXFFFFXXXFXXFXXFFXXXXXXpX-5' "AS-M158*"

3'-XpXXFXFFFFFFFFXXFXXFFXXXXXXpX-5' "AS-M159*"

3'-XpXXFXXXFXXXXXFXFXXFFXXXXXXpX-5' "AS-M160*"

3'-XpXXFXXXFXFXFXFXFXXFFXXXXXXpX-5' "AS-M161*"

3'-XXXXXXXXFXFXFXXXXXXXXXXXXXX-5' "AS-M162*"

3'-XXXXXXXXXXXXXXXXXXXXXXXXXXX-5' "AS-M163*"

3'-XXXXXXXXDXXXXXXXXXXXXXXXXXX-5' "AS-M164*"

3'-XXXXXXXXXXXXXXXXXXXXXXXXXXX-5' "AS-M211"

3'-XXXXXXXXXXXXXXXXXXXXXXXXXXX-5' "AS-M212"

3'-XXXXXXXXXXXXXXXXXXXXXXXXXXX-5' "AS-M215"

3'-XXXXXXXXXXXXXXXXXXXXXXXXXXX-5' "AS-M216"

3'-XXXXXXXXXXXXXXXXXXXXXXXXXXX-5' "AS-M217"

-continued

3'-XXXXXXXXXXXXXXXXXXXXXXXXXXX-5' "AS-M218"

3'-XXXXXXXXXXXXXXXXXXXXXXXXXXX-5' "AS-M219"

3'-XXXXXXXXXXXXXXXXXXXXXXXXXXX-5' "AS-M220"

3'-XXXXXXXXXXXXXXXXXXXXXXXXXXX-5' "AS-M221"

3'-XXXXXXXXXXXXXXXXXXXXXXXXXXX-5' "AS-M222"

3'-XXXXXXXXXXXXXXXXXXXXXXXXXXX-5' "AS-M223"

3'-XXXXXXXXXXXXXXXXXXXXXXXXXXX-5' "AS-M224"

3'-XXXXXXXXXXXXXXXXXXXXXXXXXXX-5' "AS-M225"

3'-XXXXXXXXXXXXXXXXXXXXXXXXXXX-5' "AS-M226"

3'-XXXXXXXXXXXXXXXXXXXXXXXXXXX-5' "AS-M230"

3'-XXXXXXXXXXXXXXXXXXXXXXXXXXX-5' "AS-M231"

3'-XXXXXXXXXXXXXXXXXXXXXXXXXXX-5' "AS-M232"

3'-XXXXXXXXXXXXXXXXXXXXXXXXXXX-5' "AS-M233"

3'-XXXXXXXXXXXXXXXXXXXXXXXXXXX-5' "AS-M234"

3'-XXXXXXXXXXXXXXXXXXXXXXXXXXX-5' "AS-M235"

3'-XXXXXXXXXXXXXXXXXXXXXXXXXXX-5' "AS-M236"

3'-XXXXXXXXXXXXXXXXXXXXXXXXXXX-5' "AS-M237"

3'-XXXXXXXXXXXXXXXXXXXXXXXXXXX-5' "AS-M238"

3'-XXXXXXXXXXXXXXXXXXXXXXXXXXX-5' "AS-M239"

3'-XXXXXXXXXXXXXXXXXXXXXXXXXXX-5' "AS-M240"

3'-XXXXXXXXXXXXXXXXXXXXXXXXXXX-5' "AS-M241"

3'-XXXXXXXXXXXXXXXXXXXXXXXXXXX-5' "AS-M242"

3'-XpXXXXXXXXXXXXXXXXXXXXXXXXXpX-5' "AS-M243"

3'-XpXXXXXXXXXXXXXXXXXXXXXXXXXpX-5' "AS-M244"

3'-XpXXXXXXXXXXXXXXXXXXXXXXXXXpX-5' "AS-M245"

3'-XpXXXXXXXXXXXXXXXXXXXXXXXXXpX-5' "AS-M246"

3'-XpXXXXXXXXXXXXXXXXXXXXXXXXXpX-5' "AS-M247"

3'-XpXXXXXXXXXXXXXXXXXXXXXXXXXpX-5' "AS-M248"

3'-XpXXXXXXXXXXXXXXXXXXXXXXXXXpX-5' "AS-M249"

3'-XpXXXXXXXXXXXXXXXXXXXXXXXXXpX-5' "AS-M250"

3'-XpXXXXXXXXXXXXXXXXXXXXXXXXXpX-5' "AS-M251"

3'-XpXXXXXXXXXXXXXXXXXXXXXXXXXpX-5' "AS-M252"

3'-XpXXXXXXXXXXXXXXXXXXXXXXXXXpX-5' "AS-M253"

3'-XpXXXXXXXXXXXXXXXXXXXXXXXXXpX-5' "AS-M254"

3'-XpXXXXXXXXXXXXXXXXXXXXXXXXXpX-5' "AS-M255"

3'-XXXXXXXXXXXXXXXXXXXXXXXXXXX-5' "AS-M211*"

3'-XXXXXXXXXXXXXXXXXXXXXXXXXXX-5' "AS-M212*"

3'-XXXXXXXXXXXXXXXXXXXXXXXXXXX-5' "AS-M215*"

3'-XXXXXXXXXXXXXXXXXXXXXXXXXXX-5' "AS-M216*"

3'-XXXXXXXXXXXXXXXXXXXXXXXXXXX-5' "AS-M217*"

3'-XXXXXXXXXXXXXXXXXXXXXXXXXXX-5' "AS-M218*"

-continued

3'-XXXXXXXXXXXXXXXXXXXXXXXXXXX-5' "AS-M219*"

3'-XXXXXXXXXXXXXXXXXXXXXXXXXXX-5' "AS-M220*"

3'-XXXXXXXXXXXXXXXXXXXXXXXXXXX-5' "AS-M221*"

3'-XXXXXXXXXXXXXXXXXXXXXXXXXXX-5' "AS-M222*"

3'-XXXXXXXXXXXXXXXXXXXXXXXXXXX-5' "AS-M223*"

3'-XXXXXXXXXXXXXXXXXXXXXXXXXXX-5' "AS-M224*"

3'-XXXXXXXXXXXXXXXXXXXXXXXXXXX-5' "AS-M225*"

3'-XXXXXXXXXXXXXXXXXXXXXXXXXXX-5' "AS-M226*"

3'-XXXXXXXXXXXXXXXXXXXXXXXXXXX-5' "AS-M230*"

3'-XXXXXXXXXXXXXXXXXXXXXXXXXXX-5' "AS-M231*"

3'-XXXXXXXXXXXXXXXXXXXXXXXXXXX-5' "AS-M232*"

3'-XXXXXXXXXXXXXXXXXXXXXXXXXXX-5' "AS-M233*"

3'-XXXXXXXXXXXXXXXXXXXXXXXXXXX-5' "AS-M234*"

3'-XXXXXXXXXXXXXXXXXXXXXXXXXXX-5' "AS-M235*"

3'-XXXXXXXXXXXXXXXXXXXXXXXXXXX-5' "AS-M236*"

3'-XXXXXXXXXXXXXXXXXXXXXXXXXXX-5' "AS-M237*"

3'-XXXXXXXXXXXXXXXXXXXXXXXXXXX-5' "AS-M238*"

3'-XXXXXXXXXXXXXXXXXXXXXXXXXXX-5' "AS-M239*"

3'-XXXXXXXXXXXXXXXXXXXXXXXXXXX-5' "AS-M240*"

3'-XXXXXXXXXXXXXXXXXXXXXXXXXXX-5' "AS-M241*"

3'-XXXXXXXXXXXXXXXXXXXXXXXXXXX-5' "AS-M242*"

3'-XpXXXXXXXXXXXXXXXXXXXXXXXXXpX-5' "AS-M243*"

3'-XpXXXXXXXXXXXXXXXXXXXXXXXXXpX-5' "AS-M244*"

3'-XpXXXXXXXXXXXXXXXXXXXXXXXXXpX-5' "AS-M245*"

3'-XpXXXXXXXXXXXXXXXXXXXXXXXXXpX-5' "AS-M246*"

3'-XpXXXXXXXXXXXXXXXXXXXXXXXXXpX-5' "AS-M247*"

3'-XpXXXXXXXXXXXXXXXXXXXXXXXXXpX-5' "AS-M248*"

3'-XpXXXXXXXXXXXXXXXXXXXXXXXXXpX-5' "AS-M249*"

3'-XpXXXXXXXXXXXXXXXXXXXXXXXXXpX-5' "AS-M250*"

3'-XpXXXXXXXXXXXXXXXXXXXXXXXXXpX-5' "AS-M251*"

3'-XpXXXXXXXXXXXXXXXXXXXXXXXXXpX-5' "AS-M252*"

3'-XpXXXXXXXXXXXXXXXXXXXXXXXXXpX-5' "AS-M253*"

3'-XpXXXXXXXXXXXXXXXXXXXXXXXXXpX-5' "AS-M254*"

3'-XpXXXXXXXXXXXXXXXXXXXXXXXXXpX-5' "AS-M255*"

where "X"=RNA, "X"=2'-O-methyl RNA, "D"=DNA, "F"=2'-Fluoro NA and "p"=Phosphorothioate linkage.

In certain additional embodiments, the antisense strand of selected dsRNAs of the invention are extended, optionally at the 5' end, with an exemplary 5' extension of base "AS-M8", "AS-M17" and "AS-M48" modification patterns respectively represented as follows:

(SEQ ID NO: 14860)
3'-XXXXXXXXXXXXXXXXXXXXXXXXXXXXXUAGCUAUCGT-5'
"AS-M8, extended"

(SEQ ID NO: 14860)
3'-XXXXXXXXXXXXXXXXXXXXXXXXXXXXXUAGCUAUCGT-5'
"AS-M17, extended"

(SEQ ID NO: 14860)
3'-XXXXXXXXXXXXXXXXXXXXXXXXXXXXXUAGCUAUCGT-5'
"AS-M48, extended"

where "X"=RNA; "X"=2'-O-methyl RNA; "F"=2'-Fluoro NA and "A" in bold, italics indicates a 2'-Fluoro-adenine residue.

In certain embodiments, the sense strand of a DsiRNA of the invention is modified—specific exemplary forms of sense strand modifications are shown below, and it is contemplated that such modified sense strands can be substituted for the sense strand of any of the DsiRNAs shown above to generate a DsiRNA comprising a below-depicted sense strand that anneals with an above-depicted antisense strand. Exemplary sense strand modification patterns include:

5'-XXXXXXXXXXXXXXXXXXXXXXXXXDD-3' "SM1"
5'-XXXXXXXXXXXXXXXXXXXXXXXXXDD-3' "SM2"
5'-XXXXXXXXXXXXXXXXXXXXXXXXXDD-3' "SM3"
5'-XXXXXXXXXXXXXXXXXXXXXXXXXDD-3' "SM4"
5'-XXXXXXXXXXXXXXXXXXXXXXXXXDD-3' "SM5"
5'-XXXXXXXXXXXXXXXXXXXXXXXXXDD-3' "SM6"
5'-XXXXXXXXXXXXXXXXXXXXXXXXXDD-3' "SM7"
5'-XXXXXXXXXXXXXXXXXXXXXXXXXDD-3' "SM8"
5'-XXXXXXXXXXXXXXXXXXXXXXXXXDD-3' "SM9"
5'-XXXXXXXXXXXXXXXXXXXXXXXXXDD-3' "SM10"
5'-XXXXXXXXXXXXXXXXXXXXXXXXXDD-3' "SM11"
5'-XXXXXXXXXXXXXXXXXXXXXXXXXDD-3' "SM12"
5'-XXXXXXXXXXXXXXXXXXXXXXXXXDD-3' "SM13"
5'-XXXXXXXXXXXXXXXXXXXXXXXXXDD-3' "SM14"
5'-XXXXXXXXXXXXXXXXXXXXXXXXXDD-3' "SM15"
5'-XXXXXXXXXXXXXXXXXXXXXXXXXDD-3' "SM16"
5'-XXXXXXXXXXXXXXXXXXXXXXXXXDD-3' "SM17"
5'-XXXXXXXXXXXXXXXXXXXXXXXXXDD-3' "SM18"
5'-XXXXXXXXXXXXXXXXXXXXXXXXXDD-3' "SM19"
5'-XXXXXXXXXXXXXXXXXXXXXXXXXDD-3' "SM20"
5'-XXXXXXXXXXXXXXXXXXXXXXXXXDD-3' "SM21"
5'-XXXXXXXXXXXXXXXXXXXXXXXXXDD-3' "SM23"
5'-XXXXXXXXXXXXXXXXXXXXXXXXXDD-3' "SM24"
5'-XXXXXXXXXXXXXXXXXXXXXXXXXDD-3' "SM25"
5'-XXXXXXXXXXXXXXXXXXXXXXXXXDD-3' "SM30"
5'-XXXXXXXXXXXXXXXXXXXXXXXXXDD-3' "SM31"

-continued

5'-XXXXXXXXXXXXXXXXXXXXXXXXXDD-3' "SM32"
5'-XXXXXXXXXXXXXXXXXXXXXXXXXDD-3' "SM33"
5'-XXXXXXXXXXXXXXXXXXXXXXXXXDD-3' "SM34"
5'-XXXXXXXXXXXXXXXXXXXXXXXXXDD-3' "SM35"
5'-XXXXXXXXXXXXXXXXXXXXXXXXXDD-3' "SM36"
5'-XXXXXXXXXXXXXXXXXXXXXXXXXDD-3' "SM37"
5'-XXXXXXXXXXXXXXXXXXXXXXXXXDD-3' "SM38"
5'-XXXXXXXXXXXXXXXXXXXXXXXXXDD-3' "SM39"
5'-XXXXXXXXXXXXXXXXXXXXXXXXXDD-3' "SM40"
5'-XXXXXXXXXXXXXXXXXXXXXXXXXDD-3' "SM41"
5'-XXXXXXXXXXXXXXXXXXXXXXXXXDD-3' "SM42"
5'-XXXXXXXXXXXXXXXXXXXXXXXXXDD-3' "SM43"
5'-XXXXXXXXXXXXXXXXXXXXXXXXXDD-3' "SM44"
5'-XXXXXXXXXXXXXXXXXXXXXXXXXDD-3' "SM45", "SM47"
5'-XXXXXXXXXXXXXXXXXXXXXXXXXDD-3' "SM46"
5'-XXXXXXXXXXXXXXXXXXXXXXXXXDD-3' "SM48"
5'-XXXXXXXXXXXXXXXXXXXXXXXXXDD-3' "SM49"
5'-XXXXXXXXXXXXXXXXXXXXXXXXXDD-3' "SM50"
5'-XXXXXXXXXXXXXXXXXXXXXXXXXDD-3' "SM51"
5'-XXXXXXXXXXXXXXXXXXXXXXXXXDD-3' "SM52"
5'-XXXXXXXXXXXXXXXXXXXXXXXXXDD-3' "SM53"
5'-XXXXXXXXXXXXXXXXXXXXXXXXXDD-3' "SM54"
5'-XXXXXXXXXXXXXXXXXXXXXXXXXDD-3' "SM55"
5'-XXXXXXXXXXXXXXXXXXXXXXXXXDD-3' "SM56"
5'-XXXXXXXXXXXXXXXXXXXXXXXXXDD-3' "SM57"
5'-XXXXXXXXXXXXXXXXXXXXXXXXXDD-3' "SM58"
5'-XXXXXXXXXXXXXXXXXXXXXXXXXDD-3' "SM59"
5'-XXXXXXXXXXXXXXXXXXXXXXXXXDD-3' "SM60"
5'-XXXXXXXXXXXXXXXXXXXXXXXXXDD-3' "SM61"
5'-XXXXXXXXXXXXXXXXXXXXXXXXXDD-3' "SM62"
5'-XXXXXXXXXXXXXXXXXXXXXXXXXDD-3' "SM63"
5'-XXXXXXXXXXXXXXXXXXXXXXXXXDD-3' "SM64"
5'-XXXXXXXXXXXXXXXXXXXXXXXXXDD-3' "SM65"
5'-XXXXXXXXXXXXXXXXXXXXXXXXXpDpD-3' "SM66"
5'-XpXXXXXXXXXXXXXXXXXXXXXXXXDD-3' "SM67"
5'-XpXXXXXXXXXXXXXXXXXXXXXXXXpDpD-3' "SM68"
5'-DXXXXXXXXXXXXXXXXXXXXXXXXDD-3' "SM69"
5'-DpXXXXXXXXXXXXXXXXXXXXXXXXpDpD-3' "SM70"
5'-DXDXXXXXXXXXXXXXXXXXXXXXXDD-3' "SM71"
5'-DpXDXXXXXXXXXXXXXXXXXXXXXXDD-3' "SM72"
5'-XXDXXXXXXXXXDXXXXXXXXXXXXDD-3' "SM73"

-continued

5'-XpXDXXXXXXXXXDXXXXXXXXXXDD-3' "SM74"

5'-DXDXXXXXXXXXDXXXXXDXXXXDD-3' "SM75"

5'-DpXDXXXXXXXXXDXXXXXDXXXXDD-3' "SM76"

5'-XpXpXXXXXXXXXXXXXXXXXXXXXDD-3' "SM77"

5'-XpXpXXXXXXXXXXXXXXXXXXXXXpDpD-3' "SM78"

5'-DpXpDXXXXXXXXXXXXXXXXXXXXDD-3' "SM79"

5'-XpXpDXXXXXXXXXDXXXXXXXXXXDD-3' "SM80"

5'-DXDXXXDXXXXXDXXXXXDXXXXDD-3' "SM81"

5'-DpXDXXXDXXXXXDXXXXXDXXXXpDpD-3' "SM82"

5' C3 spacer-XXXXXXXXXXXXXXXXXXXXXXXXDD-3' "SM83"

5' C3 spacer-XXDXXXXXXXXXDXXXXXXXXXXDD-3' "SM84"

5' C3 spacer-XXXXXXXXXXXXXXXXXXXXXXXXpDpD-3' "SM85"

5'-XXXXXXXXXXXXXXXXXXXXXXXXpDpD-3' "SM86"

5'-XpXXXXXXXXXXXXXXXXXXXXXXXDD-3' "SM87"

5'-XpXXXXXXXXXXXXXXXXXXXXXXXpDpD-3' "SM88"

5'-DXXXXXXXXXXXXXXXXXXXXXXXDD-3' "SM89"

5'-DpXXXXXXXXXXXXXXXXXXXXXXXpDpD-3' "SM90"

5'-DXDXXXXXXXXXXXXXXXXXXXXXDD-3' "SM91"

5'-DpXDXXXXXXXXXXXXXXXXXXXXXDD-3' "SM92"

5'-XXDXXXXXXXXXDXXXXXXXXXXDD-3' "SM93"

5'-XpXDXXXXXXXXXDXXXXXXXXXXDD-3' "SM94"

5'-DXDXXXXXXXXXDXXXXXDXXXXDD-3' "SM95"

5'-DpXDXXXXXXXXXDXXXXXDXXXXDD-3' "SM96"

5'-XpXpXXXXXXXXXXXXXXXXXXXXXDD-3' "SM97"

5'-XpXpXXXXXXXXXXXXXXXXXXXXXpDpD-3' "SM98"

5'-DpXpDXXXXXXXXXXXXXXXXXXXXDD-3' "SM99"

5'-XpXpDXXXXXXXXXDXXXXXXXXXXDD-3' "SM100"

5'-DXDXXXXXXXXXDXDXXXDDXXDDD-3' "SM101"

5'-DpXDXXXDXXXXXDXXXXXDXXXXpDpD-3' "SM102"

5' C3 spacer-XXXXXXXXXXXXXXXXXXXXXXXXDD-3' "SM103"

5' C3 spacer-XXDXXXXXXXXXDXXXXXXXXXXDD-3' "SM104"

5' C3 spacer-XXXXXXXXXXXXXXXXXXXXXXXXpDpD-3' "SM105"

5'-XXXXXXXXXXXXXXXXXXXXXXXXDD-3' "SM106"

5'-XXXXXXXXXXXXXXXXXXXXXXXXDD-3' "SM107"

5'-XXXXXXXXXXXXXXXXXXXXXXXXDD-3' "SM108"

5'-XFXXXXXXXXXXXXXXXFXXXXXDD-3' "SM110"

5'-XXXFXFXXXXXXXFXXXXXXXXXDD-3' "SM111"

5'-XFXFXFXFXXXFXFXFXFXXXXXDD-3' "SM112"

5'-XpFXFXFXFXXXFXFXFXFXXXXXpDpD-3' "SM113"

5'-XFXXXXXXXXXXXXXXXXXXXXXDD-3' "SM114"

-continued

5'-XXXXFFXFXXXFXFXXXXXXXXXDD-3' "SM115"

5'-XFXFXXXXXXXXXXXXFXXXXXXDD-3' "SM116"

5'-XFXFFFXFXXXFXFXFFFXXXXXDD-3' "SM117"

5'-XFXFXFXFXXXFXFXFXFXXXXXDD-3' "SM118"

5'-XpFXFXFXFXXXFXFXFXFXXXXXpDpD-3' "SM119"

5'-XXXXXXXXXXXXXXXXXXXXXXXXDD-3' "SM250"

5'-XXXXXXXXXXXXXXXXXXXXXXXXDD-3' "SM251"

5'-XXXXXXXXXXXXXXXXXXXXXXXXDD-3' "SM252"

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

-continued

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3' "SM22"

5'-XXXXXXXXXXXXXXXXXXXXXXXXX-3

5'-XXXXXXXXXXXXXXXXXXXXXXXXX-3'

5'-XXXXXXXXXXXXXXXXXXXXXXXXX-3'

5'-XpXXXXXXXXXXXXXXXXXXXXXXDpD-3' "SM120"

5'-FpXFXFXFXFXFXFXFXFXFXFXXDpD-3' "SM121"

5'-XpXXXXXXXXXXXXXXXXXXXXXXDpD-3' "SM122"

5'-XpXXXXXXXXXXXXXXXXXXXXXXDpD-3' "SM123"

5'-FpXFXXXFXXXXXXXXXXXXXXXXpDpD-3' "SM124"

5'-FpXFXXXFXXXXXFXFXXXXXXXXpDpD-3' "SM125"

5'-FpXFXXXFXFFFXFXFXXXXXXXXpDpD-3' "SM126"

5'-FpXFXXXFXFFFXFXFXXXFFXXXpDpD-3' "SM127"

5'-FpXFXXXFXFFFXFXFXXXFFXXFpDpD-3' "SM128"

5'-FpXFXXXFXFFFXFXFXXXFFFFFpDpD-3' "SM129"

5'-FpXFXFXFXFXFXFXFXFXFXFXFpDpD-3' "SM130"

5'-XpXXXXXXXXXXXXXXXXXXXXXXXpX-3'

5'-FpXFXFXFXFXFXFXFXFXFXFXXXpX-3'

5'-XpXXXXXXXXXXXXXXXXXXXXXXXpX-3'

5'-XpXXXXXXXXXXXXXXXXXXXXXXXpX-3'

5'-FpXFXXXFXXXXXXXXXXXXXXXXpXpX-3'

5'-FpXFXXXFXXXXXFXFXXXXXXXXpXpX-3'

5'-FpXFXXXFXFFFXFXFXXXXXXXXpXpX-3'

5'-FpXFXXXFXFFFXFXFXXXFFXXXpXpX-3'

5'-FpXFXXXFXFFFXFXFXXXFFXXFpXpX-3'

5'-FpXFXXXFXFFFXFXFXXXFFFFFpXpX-3'

5'-FpXFXFXFXFXFXFXFXFXFXFXFpXpX-3'

5'-XpXXXXXXXXXXXXXXXXXXXXXXpDpD-3' "SM133"

5'-XpXXXXXXXXXXXXXXXXXXXXXXpDpD-3' "SM134"

5'-XpXXXXXXXXXXXXXXXXXXXXXXpDpD-3' "SM135"

5'-XpXXXXXXXXXXXXXXXXXXXXXXpDpD-3' "SM136"

5'-XpXXXXXXXXXXXXXXXXXXXXXXpDpD-3' "SM137"

5'-XpXXXXXXXXXXXXXXXXXXXXXXpDpD-3' "SM138"

5'-XpXXXXXXXXXXXXXXXXXXXXXXpXpX-3'

5'-XpXXXXXXXXXXXXXXXXXXXXXXpXpX-3'

5'-XpXXXXXXXXXXXXXXXXXXXXXXpXpX-3'

5'-XpXXXXXXXXXXXXXXXXXXXXXXpXpX-3'

5'-XpXXXXXXXXXXXXXXXXXXXXXXpXpX-3'

5'-XpXXXXXXXXXXXXXXXXXXXXXXpXpX-3'

5'-XpXXXXXXXXXXXXXXXXXXXXXXDpD-3' "SM140"

5'-XpXXXXXXXXXXXXXXXXXXXXXXDpD-3' "SM141"

5'-XpXXXXXXXXXXXXXXXXXXXXXXDpD-3' "SM142"

5'-FpXFXFXFXFXFXFXFXFXXXFDpD-3' "SM143"

5'-FpXFXFXFXFXFXFXFXFXFFFFFDpD-3' "SM144"

5'-FpXFXFXFXFXFXFXFXFXXXXDpD-3' "SM145"

5'-FpXFXFXFXFXFXFXFXFXFXFXFDpD-3' "SM146"

5'-FXFXXXFXFFFXFXFXXXXXXXXDD-3' "SM147"

5'-FXFXXXFXFFFXFXFXXXFFXXXDD-3' "SM148"

5'-FXFXXXFXFFFXFXFXXXFFXXFDD-3' "SM149"

5'-FXFXXXFXFFFXFXFXXXFFFFFDD-3' "SM150"

5'-FpXFXFXFXFFFXFXFXFXFFXXFDpD-3' "SM151"

5'-FpXFXFXFXFFXFXXFXFXFXXXXDpD-3' "SM152"

5'-FpXFXFXXFFFFFXXFXFXXFXXXDpD-3' "SM153"

5'-ab-XXFXXFFFXXFFXXXFFFFXpXXXDD-3' "SM154"
(ab = abasic for F7 stabilization at 5' end)

5'-XpXXXXXXXXXXXXXXXXXXXXXXXpX-3' "SM155"

5'-XpXXXXXXXXXXXXXXXXXXXXXXXpX-3' "SM156"

5'-FpXFXXXFFFFFFFXXXFXXFXXFXpX-3' "SM157"

5'-XpXFXFXXFFFFXFXFXFXXFXXXXpX-3' "SM158"

5'-FpXFXXXFXFFXFXXFXXXFXXXXXpX-3' "SM159"

5'-FpXFXFXFXFFFXFXFXFXFXXXXXX-3' "SM160"

5'-XpXXXXXXXXXXXXXXXXXXXXXXXpX-3'

5'-XpXXXXXXXXXXXXXXXXXXXXXXXpX-3'

5'-XpXXXXXXXXXXXXXXXXXXXXXXXpX-3'

5'-FpXFXFXFXFXFXFXFXFXXXFXpX-3'

5'-FpXFXFXFXFXFXFXFXFFFFFXpX-3'

5'-FpXFXFXFXFXFXFXFXFXXXXXpX-3'

5'-FpXFXFXFXFXFXFXFXFXFXFXpX-3'

5'-FXFXXXFXFFFXFXFXXXXXXXXXX-3'

-continued

5'-FXFXXXFXFFFXFXFXXXFFXXXXX-3'

5'-FXFXXXFXFFFXFXFXXXFFXXFXX-3'

5'-FXFXXXFXFFFXFXFXXXFFFFFXX-3'

5'-FpXFXFXFXFFFXFXFXFXFFXXFXpX-3'

5'-FpXFXFXFXFFXFXXFXFXFXXXXXpX-3'

5'-FpXFXFXXFFFFFXXFXFXXFXXXXpX-3'

5'-ab-XXFXXFFFXXFFXXXFFFFXpXXXXX-3'
(ab = abasic for F7 stabilization at 5' end)

5'-XpXXXXXXXXXXXXXXXXXXXXXXXpX-3'

5'-XpXXXXXXXXXXXXXXXXXXXXXXXpX-3'

5'-FpXFXXXFFFFFFFXXXFXXFXXFXpX-3'

5'-XpXFXFXXFFFFXFXFXFXXFXXXXpX-3'

5'-FpXFXXXFXFFXFXXFXXXFXXXXXpX-3'

5'-FpXFXFXFXFFFXFXFXFXFXXXXXX-3'

5'-XXXXXXXXXXXXXXXXXXXXXXXDD-3' "SM253"

5'-XXXXXXXXXXXXXXXXXXXXXXXDD-3' "SM255"

5'-XXXXXXXXXXXXXXXXXXXXXXXDD-3' "SM256"

5'-XXXXXXXXXXXXXXXXXXXXXXXDD-3' "SM257"

5'-XXXXXXXXXXXXXXXXXXXXXXXDD-3' "SM258"

5'-XXXXXXXXXXXXXXXXXXXXXXXDD-3' "SM259"

5'-XXXXXXXXXXXXXXXXXXXXXXXDD-3' "SM260"

5'-XXXXXXXXXXXXXXXXXXXXXXXDD-3' "SM261"

5'-XXXXXXXXXXXXXXXXXXXXXXXDD-3' "SM262"

5'-XXXXXXXXXXXXXXXXXXXXXXXDD-3' "SM263"

5'-XXXXXXXXXXXXXXXXXXXXXXXDD-3' "SM264"

5'-XXXXXXXXXXXXXXXXXXXXXXXDD-3' "SM265"

5'-XXXXXXXXXXXXXXXXXXXXXXXDD-3' "SM266"

5'-XXXXXXXXXXXXXXXXXXXXXXXDD-3' "SM267"

5'-XXXXXXXXXXXXXXXXXXXXXXXDD-3' "SM268"

5'-XXXXXXXXXXXXXXXXXXXXXXXDD-3' "SM269"

5'-XXXXXXXXXXXXXXXXXXXXXXXDD-3' "SM270"

5'-XXXXXXXXXXXXXXXXXXXXXXXDD-3' "SM271"

5'-XXXXXXXXXXXXXXXXXXXXXXXDD-3' "SM275"

5'-XXXXXXXXXXXXXXXXXXXXXXXDD-3' "SM276"

5'-XXXXXXXXXXXXXXXXXXXXXXXDD-3' "SM277"

5'-XXXXXXXXXXXXXXXXXXXXXXXDD-3' "SM278"

5'-XXXXXXXXXXXXXXXXXXXXXXXDD-3' "SM279"

5'-XXXXXXXXXXXXXXXXXXXXXXXDD-3' "SM280"

5'-XXXXXXXXXXXXXXXXXXXXXXXDD-3' "SM281"

5'-XXXXXXXXXXXXXXXXXXXXXXXDD-3' "SM282"

5'-XXXXXXXXXXXXXXXXXXXXXXXDD-3' "SM283"

-continued

5'-XXXXXXXXXXXXXXXXXXXXXXXDD-3' "SM284"

5'-XXXXXXXXXXXXXXXXXXXXXXXDD-3' "SM285"

5'-XXXXXXXXXXXXXXXXXXXXXXXDD-3' "SM286"

5'-XXXXXXXXXXXXXXXXXXXXXXXDD-3' "SM287"

5'-XXXXXXXXXXXXXXXXXXXXXXXDD-3' "SM288"

5'-XXXXXXXXXXXXXXXXXXXXXXXDD-3' "SM289"

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXDD-3' "SM300"

5'-XpXXXXXXXXXXXXXXXXXXXXXXDpD-3' "SM301"

-continued

5'-XpXXXXXXXXXXXXXXXXXXXXXXDpD-3' "SM302"

5'-XpXXXXXXXXXXXXXXXXXXXXXXDpD-3' "SM303"

5'-XpXXXXXXXXXXXXXXXXXXXXXXDpD-3' "SM304"

5'-XpXXXXXXXXXXXXXXXXXXXXXXDpD-3' "SM305"

5'-XpXXXXXXXXXXXXXXXXXXXXXXDpD-3' "SM306"

5'-XpXXXXXXXXXXXXXXXXXXXXXXDpD-3' "SM307"

5'-XpXXXXXXXXXXXXXXXXXXXXXXDpD-3' "SM308"

5'-XpXXXXXXXXXXXXXXXXXXXXXXDpD-3' "SM309"

5'-XpXXXXXXXXXXXXXXXXXXXXXXDpD-3' "SM310"

5'-XXXXXXXXXXXXXXXXXXXXXXXXX-3'

5'-XpXXXXXXXXXXXXXXXXXXXXXXpX-3'

5'-XpXXXXXXXXXXXXXXXXXXXXXXpX-3'

5'-XpXXXXXXXXXXXXXXXXXXXXXXpX-3'

5'-XpXXXXXXXXXXXXXXXXXXXXXXpX-3'

5'-XpXXXXXXXXXXXXXXXXXXXXXXpX-3'

5'-XpXXXXXXXXXXXXXXXXXXXXXXpX-3'

5'-XpXXXXXXXXXXXXXXXXXXXXXXpX-3'

5'-XpXXXXXXXXXXXXXXXXXXXXXXpX-3'

5'-XpXXXXXXXXXXXXXXXXXXXXXXpX-3'

5'-XpXXXXXXXXXXXXXXXXXXXXXXpX-3' where "X"=RNA, "X"=2'-O-methyl RNA, "D"=DNA, "F"=2'-Fluoro NA and "p"=Phosphorothioate linkage.

It is contemplated that in certain embodiments of the invention, for all 2'-O-methyl modification patterns disclosed herein, any or all sites of 2'-O-methyl modification can optionally be replaced by a 2'-Fluoro modification. The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

$$5'\text{-XXXXXXXXXXXXXXXXXXXXXXXXX}^{M}{}^{M\text{-}3'}$$
$$3'\text{-XXXXXXXXXXXXXXXXXXXXXXXXX}_{M}{}_{M\text{-}5'}$$

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

$$5'\text{-XXXXXXXXXXXXXXXXXXXXXXXXX}_{N*}\text{D}_{N}\text{DD-3}'$$
$$3'\text{-YXXXXXXXXXXXXXXXXXXXXXXXXX}_{N*}\text{D}_{N}\text{XX-5}'$$

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

$$5'\text{-XXXXXXXXXXXXXXXXXXXXXXXXX}_{N*}\text{D}_{N}\text{DD-3}'$$
$$3'\text{-YXXXXXXXXXXXXXXXXXXXXXXXXX}_{N*}\text{D}_{N}\text{DD-5}'$$

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

5'-XXXXXXXXXXXXXXXXXXXXXXXXX$_{N*}$D$_N$DD-3'

3'-YXXXXXXXXXXXXXXXXXXXXXXXXX$_{N*}$D$_N$ZZ-5' wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

5'-XXXXXXXXXXXXXXXXXXXXXXXXX$_{N*}$D$_N$DD-3'

3'-YXXXXXXXXXXXXXXXXXXXXXXXXX$_{N*}$D$_N$ZZ-5' wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

5'-XXXXXXXXXXXXXXXXXXXXXXXXX$_{N*}$D$_N$DD-3'

3'-YXXXXXXXXXXXXXXXXXXXXXXXXX$_{N*}$D$_N$ZZ-5' wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

5'-XXXXXXXXXXXXXXXXXXXXXXXXX$_{N*}$[X1/D1]$_N$DD-3'

3'-YXXXXXXXXXXXXXXXXXXXXXXXXX$_{N*}$[X2/D2]$_N$ZZ-5' wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

5'-D$_N$XXXXXXXXXXXXXXXXXXXXXXXXXXX$_{N*}$$^{M}$ $^{M-3'}$

3'-D$_N$XXXXXXXXXXXXXXXXXXXXXXXXXXX$_{N*M}$ $_{M-5'}$ wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

5'-XXXXXXXXXXXXXXXXXXXXDDXX-3'

3'-YXXXXXXXXXXXXXXXXXDDXXXX-5' wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

5'-D$_N$XXXXXXXXXXXXXXXXXXXXXXXXX$_{N*}$Y-3'

3'-D$_N$XXXXXXXXXXXXXXXXXXXXXXXXX$_{N*}$-5' wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

5'-D$_N$XXXXXXXXXXXXXXXXXXXXXXXXX$_{N*}$DD-3'

3'-D$_N$XXXXXXXXXXXXXXXXXXXXXXXXX$_{N*}$XX-5' wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

5'-D$_N$XXXXXXXXXXXXXXXXXXXXXXXXX$_{N*}$DD-3'

3'-D$_N$XXXXXXXXXXXXXXXXXXXXXXXXX$_{N*}$ZZ-5' wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

5'-D$_N$XXXXXXXXXXXXXXXXXXXXXXXXX$_{N*}$DD-3'

3'-D$_N$XXXXXXXXXXXXXXXXXXXXXXXXX$_{N*}$ZZ-5' wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

5'-D$_N$ZZXXXXXXXXXXXXXXXXXXXXXXXXX$_{N*}$DD-3'

3'-D$_N$XXXXXXXXXXXXXXXXXXXXXXXXXXX$_{N*}$ZZ-5' wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

5'-D$_N$ZZXXXXXXXXXXXXXXXXXXXXXXXXX$_{N*}$Y-3'

3'-D$_N$XXXXXXXXXXXXXXXXXXXXXXXXXXX$_{N*}$-5' wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

5'-[X1/D1]$_N$XXXXXXXXXXXXXXXXXXXXXXXXX$_{N*}$DD-3'

3'-[X2/D2]$_N$XXXXXXXXXXXXXXXXXXXXXXXXX$_{N*}$ZZ-5' wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

5'-[X1/D1]$_N$XXXXXXXXXXXXXXXXXXXXXXXXXXXX$_{N*}$Y-3'

3'-[X2/D2]$_N$XXXXXXXXXXXXXXXXXXXXXXXXXXXX$_{N*}$-5' wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

5'-$D_N$XXXXXXXXXXXXXXXXXXXXXXXXXXX$_{N*}$ $^{M}$ $^{M-3'}$

3'-$D_N$XXXXXXXXXXXXXXXXXXXXXXXXXXX$_{N*M}$ $_{M-5'}$ wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

5'-XXDDXXXXXXXXXXXXXXXXXXXXX$_{N*}$Y-3'

3'-DDXXXXXXXXXXXXXXXXXXXXXXX$_{N*}$-5' or

5'-XDXDXXXXXXXXXXXXXXXXXXXXX$_{N*}$Y-3'

3'-DXDXXXXXXXXXXXXXXXXXXXXXX$_{N*}$-5' wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary Glycolate Oxidase targeting DsiRNA agents of the invention, and their associated Glycolate Oxidase target sequences, include the following, presented in the below series of tables:

Table Number:

(2) Selected Human Anti-Glycolate Oxidase DsiRNA Agents (Asymmetrics);

(3) Selected Human Anti-Glycolate Oxidase DsiRNAs, Unmodified Duplexes (Asymmetrics);

(4) DsiRNA Target Sequences (21mers) in Glycolate Oxidase mRNA;

(5) Selected Human Anti-Glycolate Oxidase "Blunt/Blunt" DsiRNAs; and (6) DsiRNA Component 19 Nucleotide Target Sequences in Glycolate Oxidase mRNA (7) Human Anti-Glycolate Oxidase DsiRNAs Predicted to have >50% Knockdown Efficacy (Asymmetrics);

(8) DsiRNA Target Sequences (21mers) of Human Anti-Glycolate Oxidase DsiRNAs Predicted to have >50% Knockdown Efficacy;

(9) "Blunt/Blunt" DsiRNAs Corresponding to Human Anti-Glycolate Oxidase DsiRNAs Predicted to have >50% Knockdown Efficacy; and

(10) DsiRNA Component 19 Nucleotide Target Sequences of Human Anti-Glycolate Oxidase DsiRNAs Predicted to have >50% Knockdown Efficacy Lengthy table referenced here

US09701966-20170711-T00001

Please refer to the end of the specification for access instructions.

Lengthy table referenced here

US09701966-20170711-T00002

Please refer to the end of the specification for access instructions.

Lengthy table referenced here

US09701966-20170711-T00003

Please refer to the end of the specification for access instructions.

Lengthy table referenced here

US09701966-20170711-T00004

Please refer to the end of the specification for access instructions.

Lengthy table referenced here

US09701966-20170711-T00005

Please refer to the end of the specification for access instructions.

Lengthy table referenced here

US09701966-20170711-T00006

Please refer to the end of the specification for access instructions.

Lengthy table referenced here

US09701966-20170711-T00007

Please refer to the end of the specification for access instructions.

Lengthy table referenced here

US09701966-20170711-T00008

Please refer to the end of the specification for access instructions.

Lengthy table referenced here

US09701966-20170711-T00009

Please refer to the end of the specification for access instructions.

Within Tables 2, 3, 5, 7 and 9 above, underlined residues indicate 2'-O-methyl residues, UPPER CASE indicates ribonucleotides, and lower case denotes deoxyribonucleotides. The DsiRNA agents of Tables 2, 3 and 7 above are 25/27mer agents possessing a blunt end. The structures and/or modification patterning of the agents of Tables 2, 3 and 7 above can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of Glycolate Oxidase expression. Similarly, the 27mer "blunt/blunt" DsiRNA structures and/or modification patterns of the agents of Tables 5 and 9 above can also be readily adapted to the above generic sequence structures, e.g., for application of modification patterning of the antisense strand to such structures and/or adaptation of such sequences to the above generic structures.

In certain embodiments, 27mer DsiRNAs possessing independent strand lengths each of 27 nucleotides are designed and synthesized for targeting of the same sites within the Glycolate Oxidase transcript as the asymmetric "25/27" structures shown in Tables 2, 3 and 7 herein. Exemplary "27/27" DsiRNAs are optionally designed with a "blunt/blunt" structure as shown for the DsiRNAs of Tables 5 and 9 above.

In certain embodiments, the dsRNA agents of the invention require, e.g., at least 15, at least 16, at least 17, at least 18, at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target Glycolate Oxidase RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target Glycolate Oxidase RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target Glycolate Oxidase RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target Glycolate Oxidase RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target Glycolate Oxidase RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target Glycolate Oxidase RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target Glycolate Oxidase RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target Glycolate Oxidase RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target Glycolate Oxidase RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target Glycolate Oxidase RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target Glycolate Oxidase RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

5'-XX$^{M}$XXXXXXXXXXXXXXXXXXXXDD-3'
3'-XXXX$_{M}$XXXXXXXXXXXXXXXXXXXXXX-5'

5'-XXX$^{M}$XXXXXXXXXXXXXXXXXXXDD-3'
3'-XXXXX$_{M}$XXXXXXXXXXXXXXXXXXXXX-5'

5'-XXXX$^{M}$XXXXXXXXXXXXXXXXXXDD-3'
3'-XXXXXX$_{M}$XXXXXXXXXXXXXXXXXXXX-5'

5'-XXXXX$^{M}$XXXXXXXXXXXXXXXXXDD-3'
3'-XXXXXXX$_{M}$XXXXXXXXXXXXXXXXXXX-5'

5'-XXXXXX$^{M}$XXXXXXXXXXXXXXXXDD-3'
3'-XXXXXXXX$_{M}$XXXXXXXXXXXXXXXXXX-5'

5'-XXXXXXX$^{M}$XXXXXXXXXXXXXXXDD-3'
3'-XXXXXXXXX$_{M}$XXXXXXXXXXXXXXXXX-5'

5'-XXXXXXXX$^{M}$XXXXXXXXXXXXXXDD-3'
3'-XXXXXXXXXX$_{M}$XXXXXXXXXXXXXXXX-5' wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target Glycolate Oxidase RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target Glycolate Oxidase RNA (which, in certain embodiments, may be advantageous in promoting efficacy and/or potency and/or duration of effect). In certain embodiments, where mismatches occur between antisense strand and target Glycolate Oxidase RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following structures.

Target RNA Sequence:
5'- . . . AXXXXXXXXXXXXXXXXXXXX . . . -3'

DsiRNAmm Sense Strand:
5'-XXXXXXXXXXXXXXXXXXXXXXXDD-3'

DsiRNAmm Antisense Strand:
3'-EXXXXXXXXXXXXXXXXXXXXXXXXXX-5'

-continued

Target RNA Sequence:
5'- . . . XAXXXXXXXXXXXXXXXXXXX . . . -3'

DsiRNAmm Sense Strand:
5'-XXXXXXXXXXXXXXXXXXXXXXXDD-3'

DsiRNAmm Antisense Strand:
3'-XEXXXXXXXXXXXXXXXXXXXXXXXXX-5'

Target RNA Sequence:
5'- . . . AXXXXXXXXXXXXXXXXXX . . . -3'

DsiRNAmm Sense Strand:
5'-BXXXXXXXXXXXXXXXXXXXXXXDD-3'

DsiRNAmm Antisense Strand:
3'-XXEXXXXXXXXXXXXXXXXXXXXXXXX-5'

Target RNA Sequence:
5'- . . . XAXXXXXXXXXXXXXXXXX . . . -3'

DsiRNAmm Sense Strand:
5'-XBXXXXXXXXXXXXXXXXXXXXXDD-3'

DsiRNAmm Antisense Strand:
3'-XXXEXXXXXXXXXXXXXXXXXXXXXXX-5'

Target RNA Sequence:
5'- . . . XXAXXXXXXXXXXXXXXXX . . . -3'

DsiRNAmm Sense Strand:
5'-XXBXXXXXXXXXXXXXXXXXXXXDD-3'

DsiRNAmm Antisense Strand:
3'-XXXXEXXXXXXXXXXXXXXXXXXXXXX-5'

Target RNA Sequence:
5'- . . . XXXAXXXXXXXXXXXXXXX . . . -3'

DsiRNAmm Sense Strand:
5'-XXXBXXXXXXXXXXXXXXXXXXXDD-3'

DsiRNAmm Antisense Strand:
3'-XXXXXEXXXXXXXXXXXXXXXXXXXXX-5'

Target RNA Sequence:
5'- . . . XXXXAXXXXXXXXXXXXXX . . . -3'

DsiRNAmm Sense Strand:
5'-XXXXBXXXXXXXXXXXXXXXXXXDD-3'

DsiRNAmm Antisense Strand:
3'-XXXXXXEXXXXXXXXXXXXXXXXXXXX-5'

Target RNA Sequence:
5'- . . . XXXXXAXXXXXXXXXXXXX . . . -3'

DsiRNAmm Sense Strand:
5'-XXXXXBXXXXXXXXXXXXXXXXXDD-3'

DsiRNAmm Antisense Strand:
3'-XXXXXXXEXXXXXXXXXXXXXXXXXXX-5'

Target RNA Sequence:
5'- . . . XXXXXXAXXXXXXXXXXXX . . . -3'

DsiRNAmm Sense Strand:
5'-XXXXXXBXXXXXXXXXXXXXXXXDD-3'

DsiRNAmm Antisense Strand:
3'-XXXXXXXXEXXXXXXXXXXXXXXXXXX-5'

Target RNA Sequence:
5'- . . . XXXXXXXAXXXXXXXXXXX . . . -3'

DsiRNAmm Sense Strand:
5'-XXXXXXXBXXXXXXXXXXXXXXXDD-3'

DsiRNAmm Antisense Strand:
3'-XXXXXXXXXEXXXXXXXXXXXXXXXXX-5'

-continued

```
Target RNA Sequence:
5'- . . . XXXXXXXXAXXXXXXXXXX . . . -3'

DsiRNAmm Sense Strand:
5'-XXXXXXXXBXXXXXXXXXXXXXXDD-3'

DsiRNAmm Antisense Strand:
3'-XXXXXXXXXXEXXXXXXXXXXXXXXXX-5'
```

wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNA agents.

In certain embodiments, the guide strand of a dsRNA of the invention that is sufficiently complementary to a target RNA (e.g., mRNA) along at least 19 nucleotides of the target gene sequence to reduce target gene expression is not perfectly complementary to the at least 19 nucleotide long target gene sequence. Rather, it is appreciated that the guide strand of a dsRNA of the invention that is sufficiently complementary to a target mRNA along at least 19 nucleotides of a target RNA sequence to reduce target gene expression can have one, two, three, or even four or more nucleotides that are mismatched with the 19 nucleotide or longer target strand sequence. Thus, for a 19 nucleotide target RNA sequence, the guide strand of a dsRNA of the invention can be sufficiently complementary to the target RNA sequence to reduce target gene levels while possessing, e.g., only 15/19, 16/19, 17/19 or 18/19 matched nucleotide residues between guide strand and target RNA sequence.

In addition to the above-exemplified structures, dsRNAs of the invention can also possess one, two or three additional residues that form further mismatches with the target Glycolate Oxidase RNA sequence. Such mismatches can be consecutive, or can be interspersed by nucleotides that form matched base pairs with the target Glycolate Oxidase RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within dsRNAs (e.g., DsiRNAs) for antisense strand nucleotides that form mismatched base pairs with target Glycolate Oxidase RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one embodiment, the position of a mismatch nucleotide (in relation to the target Glycolate Oxidase RNA sequence) of the antisense strand of a DsiRNAmm is the nucleotide residue of the antisense strand that is located immediately 3' (downstream) within the antisense strand sequence of the projected Ago2 cleavage site of the corresponding target Glycolate Oxidase RNA sequence. In other preferred embodiments, a mismatch nucleotide of the antisense strand of a DsiRNAmm (in relation to the target Glycolate Oxidase RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In dsRNA agents possessing two mismatch-forming nucleotides of the antisense strand (where mismatch-forming nucleotides are mismatch forming in relation to target Glycolate Oxidase RNA sequence), mismatches can occur consecutively (e.g., at consecutive positions along the antisense strand nucleotide sequence). Alternatively, nucleotides of the antisense strand that form mismatched base pairs with the target Glycolate Oxidase RNA sequence can be interspersed by nucleotides that base pair with the target Glycolate Oxidase RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target Glycolate Oxidase RNA sequence). For example, two residues of the antisense strand (located within the mismatch-tolerant region of the antisense strand) that form mismatched base pairs with the corresponding target Glycolate Oxidase RNA sequence can occur with zero, one, two, three, four or five matched base pairs (with respect to target Glycolate Oxidase RNA sequence) located between these mismatch-forming base pairs.

For certain dsRNAs possessing three mismatch-forming base pairs (mismatch-forming with respect to target Glycolate Oxidase RNA sequence), mismatch-forming nucleotides can occur consecutively (e.g., in a triplet along the antisense strand nucleotide sequence). Alternatively, nucleotides of the antisense strand that form mismatched base pairs with the target Glycolate Oxidase RNA sequence can be interspersed by nucleotides that form matched base pairs with the target Glycolate Oxidase RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target Glycolate Oxidase RNA). For example, three residues of the antisense strand (located within the mismatch-tolerant region of the antisense strand) that form mismatched base pairs with the corresponding target Glycolate Oxidase RNA sequence can occur with zero, one, two, three or four matched base pairs located between any two of these mismatch-forming base pairs.

For certain dsRNAs possessing four mismatch-forming base pairs (mismatch-forming with respect to target Glycolate Oxidase RNA sequence), mismatch-forming nucleotides can occur consecutively (e.g., in a quadruplet along the sense strand nucleotide sequence). Alternatively, nucleotides of the antisense strand that form mismatched base pairs with the target Glycolate Oxidase RNA sequence can be interspersed by nucleotides that form matched base pairs with the target Glycolate Oxidase RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target Glycolate Oxidase RNA sequence—similarly, the mismatch-forming residues of antisense strand positions 19 and 21 are also interspersed by one nucleotide that forms a matched base pair with the corresponding residue of the target Glycolate Oxidase RNA sequence). For example, four residues of the antisense strand (located within the mismatch-tolerant region of the antisense strand) that form mismatched base pairs with the corresponding target Glycolate Oxidase RNA sequence can occur with zero, one, two or three matched base pairs located between any two of these mismatch-forming base pairs.

The above DsiRNAmm and other dsRNA structures are described in order to exemplify certain structures of DsiRNAmm and dsRNA agents. Design of the above DsiRNAmm and dsRNA structures can be adapted to generate, e.g., DsiRNAmm forms of other DsiRNA structures shown infra. As exemplified above, dsRNAs can also be designed that possess single mismatches (or two, three or four mismatches) between the antisense strand of the dsRNA and a target sequence, yet optionally can retain perfect complementarity between sense and antisense strand sequences of a dsRNA.

It is further noted that the dsRNA agents exemplified infra can also possess insertion/deletion (in/del) structures within their double-stranded and/or target Glycolate Oxidase RNA-aligned structures. Accordingly, the dsRNAs of the invention can be designed to possess in/del variations in, e.g., antisense strand sequence as compared to target Glycolate Oxidase RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

Target RNA Sequence:
5'-. . . XXXXXXXXXXXXXXXXXXXXXHXXX . . .-3'

DsiRNA Sense Strand:
5'-XXXXXXXXXXXXXXXXXXXXXIXDD-3'

DsiRNA Antisense Strand:
3'-XXXXXXXXXXXXXXXXXXXXXXXJXXX-5'

Target RNA Sequence:
5'-. . . XXXXXXXXXXXXXXXXXXXXXXHXX . . .-3'

DsiRNA Sense Strand:
5'-XXXXXXXXXXXXXXXXXXXXXXIDD-3'

-continued

DsiRNA Antisense Strand:
3'-XXXXXXXXXXXXXXXXXXXXXXXXJXX-5'

Target RNA Sequence:
5'-. . . XXXXXXXXXXXXXXXXXXXXXXXHX . . .-3'

DsiRNA Sense Strand:
5'-XXXXXXXXXXXXXXXXXXXXXXXID-3'

DsiRNA Antisense Strand:
3'-XXXXXXXXXXXXXXXXXXXXXXXXXJX-5'

Target RNA Sequence:
5'-. . . XXXXXXXXXXXXXXXXXXXXXXXXH . . .-3'

DsiRNA Sense Strand:
5'-XXXXXXXXXXXXXXXXXXXXXXXDI-3'

DsiRNA Antisense Strand:
3'-XXXXXXXXXXXXXXXXXXXXXXXXXXJ-5' wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below structures, such mismatches are introduced within the asymmetric HAO1-1171 DsiRNA (newly-introduced mismatch residues are italicized):

HAO1-1171 25/27mer DsiRNA, mismatch position=19 of sense strand (from 5'-terminus)

(SEQ ID NO: 3460)
5'-AUAUUUUCCCAUCUGUAU*A*AUUUtt-3'

(SEQ ID NO: 580)
3'-GUUAUAAAAGGGUAGACAUAAUAAAAA-5'

Optionally, the mismatched 'A' residue of position 19 of the sense strand is alternatively 'C' or 'G'.

HAO1-1171 25/27mer DsiRNA, mismatch position=20 of sense strand (from 5'-terminus)

(SEQ ID NO: 3461)
5'-AUAUUUUCCCAUCUGUAUU*U*UUUtt-3'

(SEQ ID NO: 580)
3'-GUUAUAAAAGGGUAGACAUAAUAAAAA-5'

Optionally, the mismatched 'U' residue of position 20 of the sense strand is alternatively 'C' or 'G'.

HAO1-1171 25/27mer DsiRNA, mismatch position=21 of sense strand (from 5'-terminus)

(SEQ ID NO: 3462)
5'-AUAUUUUCCCAUCUGUAUUA*A*UUtt-3'

(SEQ ID NO: 580)
3'-GUUAUAAAAGGGUAGACAUAAUAAAAA-5'

Optionally, the mismatched 'A' residue of position 21 of the sense strand is alternatively 'C' or 'G'.

HAO1-1171 25/27mer DsiRNA, mismatch position=22 of sense strand (from 5'-terminus)

(SEQ ID NO: 3463)
5'-AUAUUUUCCCAUCUGUAUUAU*G*Utt-3'

(SEQ ID NO: 580)
3'-GUUAUAAAAGGGUAGACAUAAUAAAAA-5'

Optionally, the mismatched 'G' residue of position 22 of the sense strand is alternatively 'A' or 'C'.

HAO1-1171 25/27mer DsiRNA, mismatch position=23 of sense strand (from 5'-terminus)

(SEQ ID NO: 3464)
5'-AUAUUUUCCCAUCUGUAUUAUU*A*tt-3'

(SEQ ID NO: 580)
3'-GUUAUAAAAGGGUAGACAUAAUAAAAA-5'

Optionally, the mismatched 'A' residue of position 23 of the sense strand is alternatively 'C' or 'G'.

HAO1-1171 25/27mer DsiRNA, mismatch position=24 of sense strand (from 5'-terminus)

(SEQ ID NO: 3465)
5'-AUAUUUUCCCAUCUGUAUUAUUU*g*t-3'

(SEQ ID NO: 580)
3'-GUUAUAAAAGGGUAGACAUAAUAAAAA-5'

Optionally, the mismatched 'g' residue of position 24 of the sense strand is alternatively 'a' or 'c'.

HAO1-1171 25/27mer DsiRNA, mismatch position=25 of sense strand (from 5'-terminus)

(SEQ ID NO: 3466)
5'-AUAUUUUCCCAUCUGUAUUAUUUt*a*-3'

(SEQ ID NO: 580)
3'-GUUAUAAAAGGGUAGACAUAAUAAAAA-5'

Optionally, the mismatched 'a' residue of position 25 of the sense strand is alternatively 'c' or 'g'.

HAO1-1171 25/27mer DsiRNA, mismatch position=1 of antisense strand (from 5'-terminus)

(SEQ ID NO: 196)
5'-AUAUUUUCCCAUCUGUAUUAUUUtt-3'

(SEQ ID NO: 3467)
3'-GUUAUAAAAGGGUAGACAUAAUAAAA*U*-5'

Optionally, the mismatched 'U' residue of position 1 of the antisense strand is alternatively 'G' or 'C'.

HAO1-1171 25/27mer DsiRNA, mismatch position=2 of antisense strand (from 5'-terminus)

(SEQ ID NO: 196)
5'-AUAUUUUCCCAUCUGUAUUAUUUtt-3'

(SEQ ID NO: 3468)
3'-GUUAUAAAAGGGUAGACAUAAUAAA*C*A-5'

Optionally, the mismatched 'C' residue of position 2 of the antisense strand is alternatively 'U' or 'G'.

HAO1-1171 25/27mer DsiRNA, mismatch position=3 of antisense strand (from 5'-terminus)

(SEQ ID NO: 196)
5'-AUAUUUUCCCAUCUGUAUUAUUUtt-3'

(SEQ ID NO: 3469)
3'-GUUAUAAAAGGGUAGACAUAAUAA*U*AA-5'

Optionally, the mismatched 'U' residue of position 3 of the antisense strand is alternatively 'C' or 'G'.

HAO1-1171 25/27mer DsiRNA, mismatch position=4 of antisense strand (from 5'-terminus)

(SEQ ID NO: 196)
5'-AUAUUUUCCCAUCUGUAUUAUUUtt-3'

(SEQ ID NO: 3470)
3'-GUUAUAAAAGGGUAGACAUAAUA*C*AAA-5'

Optionally, the mismatched 'C' residue of position 4 of the antisense strand is alternatively 'U' or 'G'.

HAO1-1171 25/27mer DsiRNA, mismatch position=5 of antisense strand (from 5'-terminus)

(SEQ ID NO: 196)
5'-AUAUUUUCCCAUCUGUAUUAUUUtt-3'

(SEQ ID NO: 3471)
3'-GUUAUAAAAGGGUAGACAUAAU*U*AAAA-5'

Optionally, the mismatched 'U' residue of position 5 of the antisense strand is alternatively 'C' or 'G'.

HAO1-1171 25/27mer DsiRNA, mismatch position=6 of antisense strand (from 5'-terminus)

(SEQ ID NO: 196)
5'-AUAUUUUCCCAUCUGUAUUAUUUtt-3'

(SEQ ID NO: 3472)
3'-GUUAUAAAAGGGUAGACAUAA*A*AAAAA-5'

Optionally, the mismatched 'A' residue of position 6 of the antisense strand is alternatively 'C' or 'G'.

HAO1-1171 25/27mer DsiRNA, mismatch position=7 of antisense strand (from 5'-terminus)

(SEQ ID NO: 196)
5'-AUAUUUUCCCAUCUGUAUUAUUUtt-3'

(SEQ ID NO: 3473)
3'-GUUAUAAAAGGGUAGACAUA*U*UAAAAA-5'

Optionally, the mismatched 'U' residue of position 7 of the antisense strand is alternatively 'C' or 'G'.

As another example, in the below structures, such mismatches are introduced within the asymmetric HAO1-1378 DsiRNA (newly-introduced mismatch residues are italicized):

HAO1-1378 25/27mer DsiRNA, mismatch position=19 of sense strand (from 5'-terminus)

(SEQ ID NO: 3474)
5'-UGGAAAUAUAUUAACUGU*A*AAAAag-3'

(SEQ ID NO: 680)
3'-GGACCUUUAUAUAAUUGACAAUUUUUC-5'

Optionally, the mismatched 'A' residue of position 19 of the sense strand is alternatively 'C' or 'G'.

HAO1-1378 25/27mer DsiRNA, mismatch position=20 of sense strand (from 5'-terminus)

(SEQ ID NO: 3475)
5'-UGGAAAUAUAUUAACUGUUUAAAag-3'

(SEQ ID NO: 680)
3'-GGACCUUUAUAUAAUUGACAAUUUUUC-5'

Optionally, the mismatched 'U' residue of position 20 of the sense strand is alternatively 'C' or 'G'.

HAO1-1378 25/27mer DsiRNA, mismatch position=21 of sense strand (from 5'-terminus)

(SEQ ID NO: 3476)
5'-UGGAAAUAUAUUAACUGUUAUAAag-3'

(SEQ ID NO: 680)
3'-GGACCUUUAUAUAAUUGACAAUUUUUC-5'

Optionally, the mismatched 'U' residue of position 21 of the sense strand is alternatively 'G' or 'C'.

HAO1-1378 25/27mer DsiRNA, mismatch position=22 of sense strand (from 5'-terminus)

(SEQ ID NO: 3477)
5'-UGGAAAUAUAUUAACUGUUAAGAag-3'

(SEQ ID NO: 680)
3'-GGACCUUUAUAUAAUUGACAAUUUUUC-5'

Optionally, the mismatched 'G' residue of position 22 of the sense strand is alternatively 'U' or 'C'.

HAO1-1378 25/27mer DsiRNA, mismatch position=23 of sense strand (from 5'-terminus)

(SEQ ID NO: 3478)
5'-UGGAAAUAUAUUAACUGUUAAAUag-3'

(SEQ ID NO: 680)
3'-GGACCUUUAUAUAAUUGACAAUUUUUC-5'

Optionally, the mismatched 'U' residue of position 23 of the sense strand is alternatively 'C' or 'G'.

HAO1-1378 25/27mer DsiRNA, mismatch position=24 of sense strand (from 5'-terminus)

(SEQ ID NO: 3479)
5'-UGGAAAUAUAUUAACUGUUAAAAgg-3'

(SEQ ID NO: 680)
3'-GGACCUUUAUAUAAUUGACAAUUUUUC-5'

Optionally, the mismatched 'g' residue of position 24 of the sense strand is alternatively 't' or 'c'.

HAO1-1378 25/27mer DsiRNA, mismatch position=25 of sense strand (from 5'-terminus)

(SEQ ID NO: 3480)
5'-UGGAAAUAUAUUAACUGUUAAAAaa-3'

(SEQ ID NO: 680)
3'-GGACCUUUAUAUAAUUGACAAUUUUUC-5'

Optionally, the mismatched 'a' residue of position 25 of the sense strand is alternatively 't' or 'c'.

HAO1-1378 25/27mer DsiRNA, mismatch position=1 of antisense strand (from 5'-terminus)

(SEQ ID NO: 296)
5'-UGGAAAUAUAUUAACUGUUAAAAag-3'

(SEQ ID NO: 3481)
3'-GGACCUUUAUAUAAUUGACAAUUUUUU-5'

Optionally, the mismatched 'U' residue of position 1 of the antisense strand is alternatively 'A' or 'G'.

HAO1-1378 25/27mer DsiRNA, mismatch position=2 of antisense strand (from 5'-terminus)

(SEQ ID NO: 296)
5'-UGGAAAUAUAUUAACUGUUAAAAag-3'

(SEQ ID NO: 3482)
3'-GGACCUUUAUAUAAUUGACAAUUUUCC-5'

Optionally, the mismatched 'C' residue of position 2 of the antisense strand is alternatively 'A' or 'G'.

HAO1-1378 25/27mer DsiRNA, mismatch position=3 of antisense strand (from 5'-terminus)

(SEQ ID NO: 296)
5'-UGGAAAUAUAUUAACUGUUAAAAag-3'

(SEQ ID NO: 3483)
3'-GGACCUUUAUAUAAUUGACAAUUUAUC-5'

Optionally, the mismatched 'A' residue of position 3 of the antisense strand is alternatively 'C' or 'G'.

HAO1-1378 25/27mer DsiRNA, mismatch position=4 of antisense strand (from 5'-terminus)

(SEQ ID NO: 296)
5'-UGGAAAUAUAUUAACUGUUAAAAag-3'

(SEQ ID NO: 3484)
3'-GGACCUUUAUAUAAUUGACAAUUCUUC-5'

Optionally, the mismatched 'C' residue of position 4 of the antisense strand is alternatively 'A' or 'G'.

HAO1-1378 25/27mer DsiRNA, mismatch position=5 of antisense strand (from 5'-terminus)

(SEQ ID NO: 296)
5'-UGGAAAUAUAUUAACUGUUAAAAag-3'

(SEQ ID NO: 3485)
3'-GGACCUUUAUAUAAUUGACAAUAUUUC-5'

Optionally, the mismatched 'A' residue of position 5 of the antisense strand is alternatively 'C' or 'G'.

HAO1-1378 25/27mer DsiRNA, mismatch position=6 of antisense strand (from 5'-terminus)

(SEQ ID NO: 296)
5'-UGGAAAUAUAUUAACUGUUAAAAag-3'

(SEQ ID NO: 3486)
3'-GGACCUUUAUAUAAUUGACAAAUUUUC-5'

Optionally, the mismatched 'A' residue of position 6 of the antisense strand is alternatively 'C' or 'G'.

HAO1-1378 25/27mer DsiRNA, mismatch position=7 of antisense strand (from 5'-terminus)

(SEQ ID NO: 296)
5'-UGGAAAUAUAUUAACUGUUAAAAag-3'

(SEQ ID NO: 3487)
3'-GGACCUUUAUAUAAUUGACAUUUUUC-5'

Optionally, the mismatched 'U' residue of position 7 of the antisense strand is alternatively 'C' or 'G'.

For the above oligonucleotide strand sequences, it is contemplated that the sense strand sequence of one depicted duplex can be combined with an antisense strand of another depicted duplex, thereby forming a distinct duplex—in certain instances, such duplexes contain a mismatched residue with respect to the Glycolate Oxidase target transcript sequence, while such sense and antisense strand sequences do not present a mismatch at this residue with respect to one another (e.g., duplexes comprising SEQ ID NOs: 3466 and 3467; SEQ ID NOs: 3465 and 3468; SEQ ID NOs: 3464 and 3469, etc., are contemplated as exemplary of such duplexes).

As noted above, introduction of mismatches can be performed upon any of the DsiRNAs described herein.

The mismatches of such DsiRNA structures can be combined to produce a DsiRNA possessing, e.g., two, three or even four mismatches within the 3'-terminal four to seven nucleotides of the sense strand/5'-terminal four to seven nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary HAO1-1171 DsiRNA sequence):

(SEQ ID NO: 3488)
5'-AUAUUUUCCCAUCUGUAUXXXXXX[X]$_n$-3'

(SEQ ID NO: 3489)
3'-GUUAUAAAAGGGUAGACAUAXXXXXX[X]$_n$-5' where n=1 to 5, 1 to 10, 1 to 20, 1 to 30, 1 to 50, or 1 to 80 or more. HAO1-1171 mRNA Target: 5'-CAAUAUUUUCCCAUCUGUAUXXXXXXX-3' (SEQ ID NO: 3490).

The Glycolate Oxidase target site may also be a site which is targeted by one or more of several oligonucleotides whose complementary target sites overlap with a stated target site. For example, for an exemplary HAO1-1315 DsiRNA, it is noted that certain DsiRNAs targeting overlapping and only slightly offset Glycolate Oxidase sequences could exhibit activity levels similar to that of HAO1-1315 (e.g., HAO1-1314 to HAO1-1317 of Table 2 above). Thus, in certain embodiments, a designated target sequence region might be effectively targeted by a series of DsiRNAs possessing largely overlapping sequences. (E.g., if considering DsiRNAs of the HAO1-1314 to HAO1-1317 target site(s), a more encompassing Glycolate Oxidase transcript target sequence might be recited as, e.g., 5'-TTTCATTGCTTTTGACTTTTCAATGGGTGT-3' (SEQ ID NO: 3491), wherein any given DsiRNA (e.g., a DsiRNA selected from HAO1-1314 to HAO1-1317) only targets a sub-sequence within such a sequence region, yet the entire sequence can be considered a viable target for such a series of DsiRNAs).

Additionally and/or alternatively, mismatches within the 3'-terminal seven nucleotides of the sense strand/5'-terminal seven nucleotides of the antisense strand can be combined with mismatches positioned at other mismatch-tolerant positions, as described above.

In view of the present identification of the above-described Dicer substrate agents (DsiRNAs) as inhibitors of Glycolate Oxidase levels via targeting of specific Glycolate Oxidase sequences, it is also recognized that dsRNAs having structures similar to those described herein can also be synthesized which target other sequences within the Glycolate Oxidase sequence of NM_017545.2, or within variants thereof (e.g., target sequences possessing 80% identity, 90% identity, 95% identity, 96% identity, 97% identity, 98% identity, 99% or more identity to a sequence of NM_017545.2).

Anti-Glycolate Oxidase DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., Glycolate Oxidase RNA) of or derived from the target gene, Glycolate Oxidase (or other gene associated with a Glycolate Oxidase-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain anti-Glycolate Oxidase DsiRNA agents were selected from a pre-screened population. Design of DsiRNAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though a more recent "v4.3" algorithm represents a theoretically improved algorithm relative to siRNA scoring algorithms previously available in the art. (E.g., "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208; Khvorova et al., 2003, *Cell* 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-Glycolate Oxidase dsRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev,* 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J,* 390: 675-679). This gene is also known as Thex1 (NM_026067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem,* 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, RNA 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, *Mol Biosyst* 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, *Mol Cell* 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, *RNA* 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, *Nature* 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, *Biochemistry* 42: 7967-7975; Grunweller et al., 2003, *Nucleic Acids Res* 31: 3185-3193; Elmen et al., 2005, *Nucleic Acids Res* 33: 439-447). Even with limited incorporation, the use of LNA modifications can improve dsRNA performance in vivo and may also alter or improve off target effect profiles (Mook et al., 2007, *Mol Cancer Ther* 6: 833-843).

Synthetic nucleic acids introduced into cells or live animals can be recognized as "foreign" and trigger an immune response. Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, *Nat Biotechnol* 23: 1399-1405; Schlee et al., 2006, *Mol Ther* 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, *Nat Biotechnol* 23: 1002-1007; Sioud and Sorensen, 2003, *Biochem Biophys Res Commun* 312: 1220-1225; Sioud, 2005, *J Mol Biol* 348: 1079-1090; Ma et al., 2005, *Biochem Biophys Res Commun* 330: 755-759). RNAs transcribed within the cell are less immunogenic (Robbins et al., 2006, *Nat Biotechnol* 24: 566-571) and synthetic RNAs that are immunogenic when delivered using lipid-based methods can evade immune stimulation when introduced unto cells by mechanical means, even in vivo (Heidel et al., 2004, *Nat Biotechnol* 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-Glycolate Oxidase dsRNA agents of the present invention so long as the modification does not prevent the dsRNA agent from possessing Glycolate Oxidase inhibitory activity. In one embodiment, one or more modifications are made that enhance Dicer processing of the DsiRNA agent (an assay for determining Dicer processing of a DsiRNA is described elsewhere herein). In a second embodiment, one or more modifications are made that result in more effective Glycolate Oxidase inhibition (as described herein, Glycolate Oxidase inhibition/Glycolate Oxidase inhibitory activity of a dsRNA can be assayed via art-recognized methods for determining RNA levels, or for determining Glycolate Oxidase polypeptide levels, should such levels be assessed in lieu of or in addition to assessment of, e.g., Glycolate Oxidase mRNA levels). In a third embodiment, one or more modifications are made that support greater Glycolate Oxidase inhibitory activity (means of determining Glycolate Oxidase inhibitory activity are described supra). In a fourth embodiment, one or more modifications are made that result in greater potency of Glycolate Oxidase inhibitory activity per each dsRNA agent molecule to be delivered to the cell (potency of Glycolate Oxidase inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the dsRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, *Nucleic Acids Research* 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858,988 and 6,291,438 and in U.S. published patent application No. 2004/0203145 A1. Other modifications are disclosed in Herdewijn (2000, *Antisense Nucleic Acid Drug Dev* 10: 297-310), Eckstein (2000, *Antisense Nucleic Acid Drug Dev* 10: 117-21), Rusckowski et al. (2000, *Antisense Nucleic Acid Drug Dev* 10: 333-345), Stein et al. (2001, *Antisense Nucleic Acid Drug Dev* 11: 317-25); Vorobjev et al. (2001, *Antisense Nucleic Acid Drug Dev* 11: 77-85).

One or more modifications contemplated can be incorporated into either strand. The placement of the modifications in the dsRNA agent can greatly affect the characteristics of the dsRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments, the anti-Glycolate Oxidase DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target Glycolate Oxidase RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27mer DsiRNAs showed improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

In certain embodiments of the present invention, an anti-Glycolate Oxidase DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. According to this embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that Glycolate Oxidase inhibitory activity of the DsiRNA possessing mismatched base pairs is retained at sufficient levels (e.g., retains at least 50% Glycolate Oxidase inhibitory activity or more, at least 60% Glycolate Oxidase inhibitory activity or more, at least 70% Glycolate Oxidase inhibitory activity or more, at least 80% Glycolate Oxidase inhibitory activity or more, at least 90% Glycolate Oxidase inhibitory activity or more or at least 95% Glycolate Oxidase inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance Glycolate Oxidase inhibitory activity of a DsiRNA of the invention) and (c) base modifications such as locked nucleic acid(s) may be included in the 5' end of the sense strand. A "typical" 21mer siRNA is designed using conventional techniques. In one technique, a variety of sites are commonly tested in parallel or pools containing several distinct siRNA duplexes specific to the same target with the hope that one of the reagents will be effective (Ji et al., 2003, *FEBS Lett* 552: 247-252). Other techniques use design rules and algorithms to increase the likelihood of obtaining active RNAi effector molecules (Schwarz et al., 2003, *Cell* 115: 199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32(Webserver issue): W130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002, *Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Natl Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the Glycolate Oxidase RNA.

Glycolate Oxidase cDNA and Polypeptide Sequences

Known human and mouse Glycolate Oxidase (HAO1) cDNA and polypeptide sequences include the following: human Hydroxyacid Oxidase 1 (HAO1) NM_017545.2 and corresponding human HAO1 polypeptide sequence GenBank Accession No. NP_060015.1; and mouse wild-type HAO1 sequence GenBank Accession No. NM_010403.2 (*Mus musculus* C57BL/6 HAO1) and corresponding mouse HAO1 sequence GenBank Accession No. NP_034533.1.

In Vitro Assay to Assess dsRNA Glycolate Oxidase Inhibitory Activity

An in vitro assay that recapitulates RNAi in a cell-free system can be used to evaluate dsRNA constructs targeting Glycolate Oxidase RNA sequence(s), and thus to assess Glycolate Oxidase-specific gene inhibitory activity (also referred to herein as Glycolate Oxidase inhibitory activity) of a dsRNA. The assay comprises the system described by Tuschl et al., 1999, Genes and Development, 13, 3191-3197 and Zamore et al., 2000, Cell, 101, 25-33 adapted for use with dsRNA (e.g., DsiRNA) agents directed against Glycolate Oxidase RNA. A *Drosophila* extract derived from syncytial blastoderm is used to reconstitute RNAi activity in vitro. Target RNA is generated via in vitro transcription from a selected Glycolate Oxidase expressing plasmid using T7 RNA polymerase or via chemical synthesis. Sense and antisense dsRNA strands (for example, 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing dsRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which dsRNA is omitted from the reaction.

Alternately, internally-labeled target RNA for the assay is prepared by in vitro transcription in the presence of [$\alpha$-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without dsRNA and the cleavage products generated by the assay.

In one embodiment, this assay is used to determine target sites in the Glycolate Oxidase RNA target for dsRNA mediated RNAi cleavage, wherein a plurality of dsRNA constructs are screened for RNAi mediated cleavage of the Glycolate Oxidase RNA target, for example, by analyzing the assay reaction by electrophoresis of labeled target RNA, or by northern blotting, as well as by other methodology well known in the art.

In certain embodiments, a dsRNA of the invention is deemed to possess Glycolate Oxidase inhibitory activity if, e.g., a 50% reduction in Glycolate Oxidase RNA levels is observed in a system, cell, tissue or organism, relative to a suitable control. Additional metes and bounds for determination of Glycolate Oxidase inhibitory activity of a dsRNA of the invention are described supra.

Conjugation and Delivery of Anti-Glycolate Oxidase dsRNA Agents

In certain embodiments, the present invention relates to a method for treating a subject having or at risk of developing a disease or disorder for which inhibition of Glycolate Oxidase is predicted to or has been demonstrated to have therapeutic value (e.g., a liver disease such as primary hyperoxaluria 1 (PH1)). In such embodiments, the dsRNA can act as novel therapeutic agents for controlling the disease or disorder for which inhibition of Glycolate Oxidase is predicted to or has been demonstrated to have therapeutic value. The method comprises administering a pharmaceutical composition of the invention to the patient (e.g., human), such that the expression, level and/or activity of a Glycolate Oxidase (HAO1) RNA is reduced. The expression, level and/or activity of a polypeptide encoded by a Glycolate Oxidase (HAO1) RNA might also be reduced by a dsRNA of the instant invention, even where said dsRNA is directed against a non-coding region of the Glycolate Oxidase transcript (e.g., a targeted 5' UTR or 3' UTR sequence). Because of their high specificity, the dsRNAs of the present invention can specifically target Glycolate Oxidase (HAO1) sequences of cells and tissues, optionally even in an allele-specific manner where polymorphic alleles exist within an individual and/or population.

In the treatment of a disease or disorder for which inhibition of Glycolate Oxidase is predicted to or has been demonstrated to have therapeutic value, the dsRNA can be brought into contact with the cells or tissue of a subject, e.g., the cells or tissue of a subject exhibiting disregulation of Glycolate Oxidase and/or otherwise targeted for reduction of Glycolate Oxidase levels. For example, dsRNA substantially identical to all or part of a Glycolate Oxidase RNA sequence may be brought into contact with or introduced into such a cell, either in vivo or in vitro. Similarly, dsRNA substantially identical to all or part of a Glycolate Oxidase RNA sequence may be administered directly to a subject having or at risk of developing a disease or disorder for which inhibition of Glycolate Oxidase is predicted to or has been demonstrated to have therapeutic value.

Therapeutic use of the dsRNA agents of the instant invention can involve use of formulations of dsRNA agents comprising multiple different dsRNA agent sequences. For example, two or more, three or more, four or more, five or more, etc. of the presently described agents can be combined to produce a formulation that, e.g., targets multiple different regions of the Glycolate Oxidase RNA, or that not only target Glycolate Oxidase RNA but also target, e.g., cellular target genes associated with a disease or disorder for which inhibition of Glycolate Oxidase is predicted to or has been demonstrated to have therapeutic value. A dsRNA agent of the instant invention may also be constructed such that either strand of the dsRNA agent independently targets two or more regions of Glycolate Oxidase RNA, or such that one of the strands of the dsRNA agent targets a cellular target gene of Glycolate Oxidase known in the art.

Use of multifunctional dsRNA molecules that target more then one region of a target nucleic acid molecule can also provide potent inhibition of Glycolate Oxidase RNA levels and expression. For example, a single multifunctional dsRNA construct of the invention can target both the HAO1-1171 and HAO1-1378 sites simultaneously; additionally and/or alternatively, single or multifunctional agents of the invention can be designed to selectively target one splice variant of Glycolate Oxidase over another.

Thus, the dsRNA agents of the instant invention, individually, or in combination or in conjunction with other drugs, can be used to treat, inhibit, reduce, or prevent a disease or disorder for which inhibition of Glycolate Oxidase is predicted to or has been demonstrated to have therapeutic value. For example, the dsRNA molecules can be administered to a subject or can be administered to other appropriate cells evident to those skilled in the art, individually or in combination with one or more drugs under conditions suitable for the treatment.

The dsRNA molecules also can be used in combination with other known treatments to treat, inhibit, reduce, or prevent a disease or disorder for which inhibition of Glycolate Oxidase is predicted to or has been demonstrated to have therapeutic value in a subject or organism. For example, the described molecules could be used in combination with one or more known compounds, treatments, or procedures to treat, inhibit, reduce, or prevent a disease or disorder for which inhibition of Glycolate Oxidase is predicted to or has been demonstrated to have therapeutic value in a subject or organism as are known in the art.

A dsRNA agent of the invention can be conjugated (e.g., at its 5' or 3' terminus of its sense or antisense strand) or unconjugated to another moiety (e.g. a non-nucleic acid moiety such as a peptide), an organic compound (e.g., a dye, cholesterol, or the like). Modifying dsRNA agents in this way may improve cellular uptake or enhance cellular targeting activities of the resulting dsRNA agent derivative as compared to the corresponding unconjugated dsRNA agent, are useful for tracing the dsRNA agent derivative in the cell, or improve the stability of the dsRNA agent derivative compared to the corresponding unconjugated dsRNA agent.

In certain embodiments, specific exemplary forms of dsRNA conjugates are contemplated. Notably, RNAi therapies, such as the dsRNAs that are specifically exemplified herein, have demonstrated particularly good ability to be delivered to the cells of the liver in vivo (via, e.g., lipid nanoparticles and/or conjugates such as dynamic polyconjugates or GalNAc conjugates—in certain exemplary embodiments, one or more GalNAc moieties can be conjugated to a 3'- and/or 5'-overhang region of a dsNA, optionally to an "extended" overhang region of a dsNA (e.g., to a 5 or more nucleotide, 8 or more nucleotide, etc. example of such an overhang); additionally and/or alternatively, one or more GalNAc moieties can be conjugated to ds extended regions of a dsNA, e.g., to the duplex region formed by the 5'-end region of the guide/antisense strand of a dsNA and the corresponding 3'-end region of the passenger/sense strand of a dsNA and/or to the duplex region formed by the 3'-end region of the guide/antisense strand of a dsNA and the corresponding 5'-end region of the passenger/sense strand of a dsNA). Thus, formulated RNAi therapies, such as those described herein, are attractive modalities for treating or preventing diseases or disorders that are present in, originate in or otherwise involve the liver.

Methods of Introducing Nucleic Acids, Vectors, and Host Cells dsRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The dsRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or otherwise increase inhibition of the target Glycolate Oxidase RNA.

A cell having a target Glycolate Oxidase RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target Glycolate Oxidase RNA sequence and the dose of dsRNA agent material delivered, this process may provide partial or complete loss of function for the Glycolate Oxidase RNA. A reduction or loss of RNA levels or expression (either Glycolate Oxidase RNA expression or encoded polypeptide expression) in at least 50%, 60%, 70%, 80%, 90%, 95% or 99% or more of targeted cells is exemplary. Inhibition of Glycolate Oxidase RNA levels or expression refers to the absence (or observable decrease) in the level of Glycolate Oxidase RNA or Glycolate Oxidase RNA-encoded protein. Specificity refers to the ability to inhibit the Glycolate Oxidase RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target Glycolate Oxidase RNA sequence(s) by the dsRNA agents of the invention also can be measured based upon the effect of administration of such dsRNA agents upon development/progression of a disease or disorder for which inhibition of Glycolate Oxidase is predicted to or has been demonstrated to have therapeutic value, e.g., primary hyperoxaluria 1 (PH1) or other rare liver disease, either in vivo or in vitro. Treatment and/or reductions in PH1 and/or other rare liver disease can include halting or reduction of organ damage (e.g., kidney and/or liver damage) associated with PH1 or other rare liver disease (e.g., reduction of kidney damage, liver damage, calcium oxalate depositions, systemic oxalosis, osteolytic lesions, epiphysiolysis (e.g., in the bone of a subject), renal osteopathy, including renal calcification and/or calcification/calcium oxalate depositions of the skin, eye or other organs of, e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in kidney damage, liver damage, calcium oxalate depositions, systemic oxalosis, osteolytic lesions, epiphysiolysis (e.g., in the bone of a subject), renal osteopathy, including renal calcification and calcification/calcium oxalate depositions of the skin, eye or other organs could be achieved via administration of the dsRNA agents of the invention to cells, a tissue, or a subject).

For RNA-mediated inhibition in a cell line or whole organism, expression of a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentamycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target Glycolate Oxidase RNA or translation of target protein. As an example, the efficiency of inhibition may be determined by assessing the amount of gene product in the cell; RNA may be detected with a hybridization probe having a nucleotide sequence outside the region used for the inhibitory dsRNA, or translated polypeptide may be detected with an antibody raised against the polypeptide sequence of that region.

The dsRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

Glycolate Oxidase Biology

Glycolate oxidase (the product of the HAO1 gene) is the enzyme responsible for converting glycolate to glyoxylate in the mitochondrial/peroxisomal glycine metabolism pathway. While glycolate is a harmless intermediate of the glycine metabolism pathway, accumulation of glyoxylate (via, e.g., AGT1 mutation) drives oxalate accumulation (as calcium precipitates in the kidney initially and other organs eventually), which ultimately results in the PH1 disease.

Pharmaceutical Compositions

In certain embodiments, the present invention provides for a pharmaceutical composition comprising the dsRNA agent of the present invention. The dsRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the dsRNA agent of the instant invention can be formulated in buffer solutions such as phosphate buffered saline solutions, liposomes, micellar structures, and capsids. Formulations of dsRNA agent with cationic lipids can be used to facilitate transfection of the dsRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; cHuh7ting agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, single dose amounts of a dsRNA (or, e.g., a construct(s) encoding for such dsRNA) in the range of approximately 1 pg to 1000 mg may be administered; in some embodiments, 10, 30, 100, or 1000 pg, or 10, 30, 100, or 1000 ng, or 10, 30, 100, or 1000 μg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a nucleic acid (e.g., dsRNA), protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing dsRNA agents into the environment of the cell will depend on the type of cell and the make up of its environment. For example, when the cells are found within a liquid, one preferable formulation is with a lipid formulation such as in lipofectamine and the dsRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate dsRNA agents in a buffer or saline solution and directly inject the formulated dsRNA agents into cells, as in studies with oocytes. The direct injection of dsRNA agent duplexes may also be done. For suitable methods of introducing dsRNA (e.g., DsiRNA agents), see U.S. published patent application No. 2004/0203145 A1.

Suitable amounts of a dsRNA agent must be introduced and these amounts can be empirically determined using standard methods. Typically, effective concentrations of individual dsRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the dsRNA agent compositions to an extracellular matrix in which cells can live provided that the dsRNA agent composition is formulated so that a sufficient amount of the dsRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of a Glycolate Oxidase RNA can be determined by a suitable method now known in the art or that is later developed. It can be appreciated that the method used to measure a target RNA and/or the expression of a target RNA can depend upon the nature of the target RNA. For example, where the target Glycolate Oxidase RNA sequence encodes a protein, the term "expression" can refer to a protein or the Glycolate Oxidase RNA/transcript derived from the Glycolate Oxidase gene (either genomic or of exogenous origin). In such instances the expression of the target Glycolate Oxidase RNA can be determined by measuring the amount of Glycolate Oxidase RNA/transcript directly or by measuring the amount of Glycolate Oxidase protein. Protein can be measured in protein assays such as by staining or immunoblotting or, if the protein catalyzes a reaction that can be measured, by measuring reaction rates. All such methods are known in the art and can be used. Where target Glycolate Oxidase RNA levels are to be measured, art-recognized methods for detecting RNA levels can be used (e.g., RT-PCR, Northern Blotting, etc.). In targeting Glycolate Oxidase RNAs with the dsRNA agents of the instant invention, it is also anticipated that measurement of the efficacy of a dsRNA agent in reducing levels of Glycolate Oxidase RNA or protein in a subject, tissue, in cells, either in vitro or in vivo, or in cell extracts can also be used to determine the extent of reduction of Glycolate Oxidase-associated phenotypes (e.g., disease or disorders, e.g., PH1, PH1-associated biomarkers and/or phenotypes, other rare liver diseases and associated biomarkers and/or phenotypes, etc.). The above measurements can be made on cells, cell extracts, tissues, tissue extracts or other suitable source material.

The determination of whether the expression of a Glycolate Oxidase RNA has been reduced can be by a suitable method that can reliably detect changes in RNA levels. Typically, the determination is made by introducing into the environment of a cell undigested dsRNA such that at least a portion of that dsRNA agent enters the cytoplasm, and then measuring the level of the target RNA. The same measurement is made on identical untreated cells and the results obtained from each measurement are compared.

The dsRNA agent can be formulated as a pharmaceutical composition which comprises a pharmacologically effective amount of a dsRNA agent and pharmaceutically acceptable carrier. A pharmacologically or therapeutically effective amount refers to that amount of a dsRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.001 to 5 micrograms per kilogram of body weight per day, or in the range of 1 to 500 nanograms per kilogram of body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. A pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by Glycolate Oxidase (e.g., normal functioning or misregulation and/or elevation of HAO1 transcript and/or Glycolate Oxidase protein levels), or treatable via selective targeting of Glycolate Oxidase.

"Treatment", or "treating" as used herein, is defined as the application or administration of a therapeutic agent (e.g., a dsRNA agent or vector or transgene encoding same) to a patient, or application or administration of a therapeutic agent to an isolated tissue or cell line from a patient, who has the disease or disorder, a symptom of disease or disorder or a predisposition toward a disease or disorder, with the purpose to cure, heal, alleviate, relieve, alter, remedy, ameliorate, improve or affect the disease or disorder, the symptoms of the disease or disorder, or the predisposition toward disease.

In one aspect, the invention provides a method for preventing in a subject, a disease or disorder as described above (including, e.g., prevention of the commencement of, e.g., PH1-forming events within a subject via inhibition of Glycolate Oxidase expression), by administering to the subject a therapeutic agent (e.g., a dsRNA agent or vector or transgene encoding same). Subjects at risk for the disease can be identified by, for example, one or a combination of diagnostic or prognostic assays as described herein. Administration of a prophylactic agent can occur prior to the detection of, e.g., PH1 in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the dsRNA agent) or, alternatively, in vivo (e.g., by administering the dsRNA agent to a subject).

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target HAO1 RNA molecules of the present invention or target HAO1 RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Therapeutic agents can be tested in a selected animal model. For example, a dsRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Models Useful to Evaluate the Down-Regulation of HAO1 mRNA Levels and Expression Cell Culture The dsRNA agents of the invention can be tested for cleavage activity in vivo, for example, using the following procedure. The nucleotide sequences within the HAO1 cDNA targeted by the dsRNA agents of the invention are shown in the above HAO1 sequences.

The dsRNA reagents of the invention can be tested in cell culture using HeLa or other mammalian cells (e.g., human cell lines Hep3B, HepG2, DU145, Calu3, SW480, T84, PL45, etc., and mouse cell lines Hepal-6, AML12, Neuro2a, etc.) to determine the extent of HAO1 RNA and/or Glycolate Oxidase protein inhibition. In certain embodiments, DsiRNA reagents (e.g., see FIG. 1, and above-recited structures) are selected against the HAO1 target as described herein. HAO1 RNA inhibition is measured after delivery of these reagents by a suitable transfection agent to, for example, cultured HeLa cells or other transformed or non-transformed mammalian cells in culture. Relative amounts of target HAO1 RNA are measured by reporter assay (e.g., as exemplified below) and/or versus HPRT1, actin or other appropriate control using real-time PCR monitoring of amplification (e.g., ABI 7700 TAQMAN®). A comparison is made to the activity of oligonucleotide sequences made to unrelated targets or to a randomized DsiRNA control with the same overall length and chemistry, or simply to appropriate vehicle-treated or untreated controls. Primary and secondary lead reagents are chosen for the target and optimization performed.

TAQMAN® (Real-Time PCR Monitoring of Amplification) and Lightcycler Quantification of mRNA For RT-qPCR assays, total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAMRA conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1× TaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target HAO1 mRNA level is determined relative to standards generated from serially diluted total cellular RNA (300, 100, 30, 10 ng/rxn) and normalizing to, for example, HPRT1 mRNA in either parallel or same tube TaqMan reactions.

Western Blotting

Cellular protein extracts can be prepared using a standard micro preparation technique (for example using RIPA buffer). Cellular protein extracts are run on Tris-Glycine polyacrylamide gel and transferred onto membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected on a VersaDoc imaging system In several cell culture systems, cationic lipids have been shown to enhance the bioavailability of oligonucleotides to cells in culture (Bennet, et al., 1992, Mol. Pharmacology, 41, 1023-1033). In one embodiment, dsRNA molecules of the invention are complexed with cationic lipids for cell culture experiments. dsRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. dsRNA molecules are added to OptiMEM to the desired concentration and the solution is added to the diluted dsRNA and incubated for 15 minutes at room temperature. In dose response experiments, the RNA complex is serially diluted into OptiMEM prior to addition of the cationic lipid.

Animal Models

The efficacy of anti-HAO1 dsRNA agents may be evaluated in an animal model. Animal models of PH1 as are known in the art can be used for evaluation of the efficacy, potency, toxicity, etc. of anti-HAO1 dsRNAs. Exemplary animal models useful for assessment of anti-HAO1 dsRNAs include mouse models of glycolate challenge and genetically engineered mouse models of PH1 disease. Such animal models may also be used as source cells or tissue for assays of the compositions of the invention. Such models can additionally be used or adapted for use for pre-clinical evaluation of the efficacy of dsRNA compositions of the invention in modulating HAO1 gene expression toward therapeutic use.

Such models and/or wild-type mice can be used in evaluating the efficacy of dsRNA molecules of the invention to inhibit HAO1 levels, expression, development of HAO1-associated phenotypes, diseases or disorders, etc. These models, wild-type mice and/or other models can similarly be used to evaluate the safety/toxicity and efficacy of dsRNA molecules of the invention in a pre-clinical setting.

Specific examples of animal model systems useful for evaluation of the HAO1-targeting dsRNAs of the invention include wild-type mice and genetically engineered alanine-glyoxylate aminotransferase-deficient model mice (see Salido et al. *Proc. Natl. Acad. Sci. USA* 103(48): 18249-54). In an exemplary in vivo experiment, dsRNAs of the invention are tail vein injected into such mouse models at doses ranging from 0.01 to 0.1 to 1 mg/kg or, alternatively, repeated doses are administered at single-dose $IC_{50}$ levels, and organ samples (e.g., liver, but may also include prostate, kidney, lung, pancreas, colon, skin, spleen, bone marrow, lymph nodes, mammary fat pad, etc.) are harvested 24 hours after administration of the final dose. Such organs are then evaluated for mouse and/or human HAO1 levels, depending upon the model used, and/or for impact upon PH1-related phenotypes. Duration of action can also be examined at, e.g., 1, 4, 7, 14, 21 or more days after final dsRNA administration.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (Danio rerio), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Example 1: Preparation of Double-Stranded RNA Oligonucleotides

Oligonucleotide Synthesis and Purification

DsiRNA molecules were designed to interact with various sites in the RNA message, for example, target sequences within the RNA sequences described herein. In presently exemplified agents, 384 human target HAO1 sequences were selected for evaluation (a selection of the 384 human target HAO1 sites were predicted to be conserved with corresponding sites in the mouse HAO1 transcript sequence). The sequences of one strand of the DsiRNA molecules were complementary to the target HAO1 site sequences described above. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 min step-linear gradient. The gradient varied from 90:10 Buffers A:B to 52:48 Buffers A:B, where Buffer A was 100 mM Tris pH 8.5 and Buffer B was 100 mM Tris pH 8.5, 1 M NaCl. Samples were monitored at 260 nm and peaks corresponding to the full-length oligonucleotide species were collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 μm inner diameter and contained ssDNA 100R Gel (Beckman-Coulter). Typically, about 0.6 nmole of oligonucleotide was injected into a capillary, run in an electric field of 444 V/cm and detected by UV absorbance at 260 nm. Denaturing Tris-Borate-7 M-urea running buffer was purchased from Beckman-Coulter. Oligoribonucleotides were obtained that were at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 1001.1M concentration in duplex buffer consisting of 100 mM potassium acetate, 30 mM HEPES, pH 7.5. Complementary sense and antisense strands were mixed in equal molar amounts to yield a final solution of, e.g., 50 μM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell Culture and RNA Transfection

HeLa cells were obtained and maintained in DMEM (HyClone) supplemented with 10% fetal bovine serum (HyClone) at 37° C. under 5% CO2. For RNA transfections, cells were transfected with DsiRNAs at a final concentration of 1 nM or 0.1 nM using Lipofectamine™ RNAiMAX (Invitrogen) and following manufacturer's instructions. Briefly, for 0.1 nM transfections, e.g., of Example 3 below, an aliquot of stock solution of each DsiRNA was mixed with Opti-MEM I (Invitrogen) and Lipofectamine™ RNAiMAX to reach a volume of 150 μL (with 0.3 nM DsiRNA). The resulting 150 μL mix was incubated for 20 min at RT to allow DsiRNA:Lipofectamine™ RNAiMAX complexes to form. Meanwhile, target cells were trypsinized and resuspended in medium. At the end of the 20 min of complexation, 50 uL of the DsiRNA:RNAiMAX mixture was added per well into triplicate wells of 96 well plates. Finally, 100 μL of the cell suspension was added to each well (final volume 150 μL) and plates were placed into the incubator for 24 hours.

Assessment of Glycolate Oxidase Inhibition

HAO1 target gene knockdown in human HeLa cells was determined by reporter assay (HeLa cells were transformed with a Psi-Check-HsHAO1 plasmid and *Renilla* luciferase levels were then detected using a luminometer), while HAO1 target gene knockdown in mouse Hepal-6 cells was determined by qRT-PCR, with values normalized to HPRT and RPL23 housekeeping genes, and to transfections with control DsiRNAs and/or mock transfection controls.

RNA Isolation and Analysis

Media was aspirated, and total RNA was extracted using the SV96 kit (Promega). Total RNA was reverse-transcribed using SuperscriptII, Oligo dT, and random hexamers following manufacturer's instructions. Typically, the resulting cDNA was analyzed by qPCR using primers and probes specific for both the HAO1 gene and for the mouse genes HPRT-1 and RPL23. An ABI 7700 was used for the amplification reactions. Each sample was tested in triplicate. Relative Glycolate Oxidase RNA levels were normalized to HPRT1 and RPL23 RNA levels and compared with RNA levels obtained in transfection control samples.

Example 2: DsiRNA Inhibition of Glycolate Oxidase

DsiRNA molecules targeting Glycolate Oxidase were designed and synthesized as described above and tested in human HeLa cells (alternatively, HepG2 or other human cells could have been used) for inhibitory efficacy. For transfection, annealed DsiRNAs were mixed with the transfection reagent (Lipofectamine™ RNAiMAX, Invitrogen) and incubated for 20 minutes at room temperature. The HeLa (human) or Hepal-6 (mouse) cells (alternatively, mouse AML12 or other mouse cells could have been used) were trypsinized, resuspended in media, and added to wells (100 uL per well) to give a final DsiRNA concentration of 1 nM in a volume of 150 μl. Each DsiRNA transfection mixture was added to 3 wells for triplicate DsiRNA treatments. Cells were incubated at 37° C. for 24 hours in the continued presence of the DsiRNA transfection mixture. At 24 hours, human cells were subjected to luminometer assay for detection of *Renilla* luciferase levels or RNA was prepared from each well of treated mouse cells. For such mouse cells, the supernatants with the transfection mixtures were first removed and discarded, then the cells were lysed and RNA was prepared from each well. Target reporter luciferase levels (human) or HAO1 RNA levels (mouse) following treatment were evaluated by luminometer (human) or qRT-PCR (mouse) for the HAO1 target gene, with values normalized to those obtained for controls. Triplicate data was averaged and the % error was determined for each treatment. Normalized data were both tabulated and graphed, and the reduction of target mRNA by active DsiRNAs in comparison to controls was determined (see Table 11 below and FIGS. 2A to 2F).

TABLE 11

Glycolate Oxidase Inhibitory Efficacy of DsiRNAs Assayed at 1 nM in Human HeLa and Mouse HEPA1-6 Cells

| | | | Human - HeLa Human Psi-Check-HsHAO1 Plasmid RLuc Remaining vs. NC1, NC5, NC7 | Mouse - Hepa1-6 Normalized HPRT/Rpl23; vs NC1, NC5, NC7 | |
|---|---|---|---|---|---|
| Duplex Name | Mm Location | Macaque* Location | Hs HAO1 Reporter Assay % Remaining | Mm HAO1 476-611 (FAM) Assay % Remaining | Mm HAO1 1775-1888 (HEX) Assay % Remaining |
| HAO1-118 | 114 | | 30.5 ± 7.1 | 88.3 ± 3.4 | 87.9 ± 4.2 |
| HAO1-119 | 115 | | 47.5 ± 2.7 | 102.7 ± 5.6 | 97.5 ± 7.2 |
| HAO1-120 | 116 | | 29.8 ± 5.8 | 100.5 ± 3.9 | 91.6 ± 7.6 |
| HAO1-121 | 117 | | 44.8 ± 3.6 | 96.4 ± 7.0 | 106.2 ± 6.6 |
| HAO1-122 | 118 | | 21.9 ± 0.9 | 83.2 ± 4.1 | 95.2 ± 10.2 |
| HAO1-123 | 119 | | 22.1 ± 6.4 | 95.5 ± 2.7 | 103.6 ± 8.7 |
| HAO1-124 | 120 | | 20.2 ± 1.2 | 82.2 ± 3.0 | 88.8 ± 5.9 |
| HAO1-125 | 121 | | 22.7 ± 2.4 | 86.6 ± 9.5 | 86.4 ± 4.0 |
| HAO1-126 | 122 | | 27.9 ± 11.0 | 77.7 ± 4.6 | 75.7 ± 5.0 |
| HAO1-127 | 123 | | 21.8 ± 5.0 | 97.9 ± 4.3 | 83.7 ± 6.2 |
| HAO1-128 | 124 | | 26.2 ± 3.8 | 101.7 ± 12.0 | 97.2 ± 14.4 |
| HAO1-129 | 125 | | 27.0 ± 2.0 | 92.8 ± 7.0 | 96.2 ± 13.6 |
| HAO1-238 | 234 | 310 | 33.7 ± 4.8 | 89.7 ± 6.4 | 119.2 ± 7.7 |
| HAO1-239 | 235 | 311 | 57.3 ± 6.0 | 93.3 ± 2.6 | 110.7 ± 9.3 |
| HAO1-502 | 498 | 574 | 39.4 ± 5.8 | 72.5 ± 2.4 | 83.8 ± 1.9 |
| HAO1-503 | 499 | 575 | 40.0 ± 5.0 | 90.6 ± 7.3 | 82.3 ± 5.6 |
| HAO1-583 | 579 | 655 | 48.5 ± 12.6 | 42.5 ± 7.1 | 38.5 ± 7.1 |
| HAO1-584 | 580 | 656 | 76.1 ± 2.3 | 45.5 ± 5.7 | 38.3 ± 10.7 |
| HAO1-753 | 749 | 825 | 37.8 ± 2.8 | 85.6 ± 9.6 | 90.7 ± 10.2 |
| HAO1-754 | 750 | 826 | 24.1 ± 1.4 | 40.8 ± 2.3 | 48.7 ± 6.4 |
| HAO1-755 | 751 | 827 | 25.8 ± 6.2 | 40.6 ± 5.8 | 51.8 ± 7.4 |
| HAO1-756 | 752 | 828 | 38.6 ± 5.3 | 76.5 ± 5.3 | 85.5 ± 9.4 |
| HAO1-757 | 753 | 829 | 39.0 ± 3.6 | 70.0 ± 2.3 | 76.0 ± 3.4 |
| HAO1-758 | 754 | 830 | 32.6 ± 1.1 | 70.7 ± 8.3 | 65.5 ± 5.6 |
| HAO1-759 | 755 | 831 | 29.8 ± 2.7 | 40.0 ± 9.0 | 29.8 ± 13.2 |
| HAO1-760 | 756 | 832 | 36.4 ± 3.2 | 62.6 ± 10.7 | 60.7 ± 11.5 |
| HAO1-761 | 757 | 833 | 42.6 ± 15.0 | 104.0 ± 8.5 | 111.7 ± 10.2 |
| HAO1-762 | 758 | 834 | 40.8 ± 2.0 | 58.2 ± 4.5 | 74.6 ± 3.7 |
| HAO1-763 | 759 | 835 | 48.6 ± 19.9 | 81.5 ± 5.9 | 91.8 ± 14.1 |
| HAO1-806 | 802 | 878 | 22.9 ± 5.6 | 48.8 ± 2.4 | 53.6 ± 4.9 |
| HAO1-807 | 803 | 879 | 31.6 ± 7.3 | 42.4 ± 5.0 | 46.1 ± 2.4 |
| HAO1-808 | 804 | 880 | 53.2 ± 10.2 | 69.5 ± 6.0 | 61.3 ± 1.9 |
| HAO1-809 | 805 | 881 | 25.3 ± 6.4 | 24.8 ± 16.7 | 28.2 ± 19.1 |
| HAO1-810 | 806 | 882 | 31.2 ± 4.7 | 40.2 ± 5.4 | 45.0 ± 14.4 |
| HAO1-811 | 807 | 883 | 45.1 ± 5.6 | 64.6 ± 6.4 | 73.2 ± 3.3 |
| HAO1-812 | 808 | 884 | 53.7 ± 2.4 | 74.6 ± 3.5 | 85.5 ± 8.6 |
| HAO1-813 | 809 | 885 | 51.0 ± 2.1 | 86.7 ± 5.7 | 120.4 ± 11.2 |
| HAO1-814 | 810 | 886 | 36.0 ± 0.8 | 68.8 ± 7.4 | 72.2 ± 17.9 |
| HAO1-815 | 811 | 887 | 18.3 ± 5.9 | 22.8 ± 5.5 | 29.6 ± 4.9 |
| HAO1-886 | 882 | | 51.6 ± 4.9 | 87.4 ± 11.4 | 88.1 ± 7.5 |
| HAO1-887 | 883 | | 33.3 ± 6.5 | 37.1 ± 3.9 | 34.0 ± 7.2 |
| HAO1-1023 | 1019 | 1095 | 32.5 ± 7.9 | 41.4 ± 6.1 | 37.5 ± 2.5 |
| HAO1-1024 | 1020 | 1096 | 35.8 ± 7.4 | 53.7 ± 17.7 | 42.6 ± 22.0 |
| HAO1-1025 | 1021 | 1097 | 24.6 ± 5.4 | 27.8 ± 4.5 | 29.7 ± 9.7 |
| HAO1-1026 | 1022 | 1098 | 32.6 ± 4.6 | 48.1 ± 3.4 | 55.6 ± 11.8 |
| HAO1-1027 | 1023 | 1099 | 21.7 ± 1.9 | 33.3 ± 3.0 | 36.3 ± 1.8 |
| HAO1-1028 | 1024 | 1100 | 23.8 ± 2.5 | 32.1 ± 4.4 | 32.4 ± 8.6 |
| HAO1-1029 | 1025 | | 18.1 ± 3.6 | 48.4 ± 9.8 | 48.8 ± 16.6 |
| HAO1-1030 | 1026 | | 26.0 ± 4.6 | 30.4 ± 9.6 | 22.3 ± 26.6 |
| HAO1-1031 | 1027 | | 46.5 ± 1.1 | 47.8 ± 11.2 | 46.9 ± 15.0 |
| HAO1-1032 | 1028 | | 47.0 ± 3.3 | 32.4 ± 26.5 | 32.8 ± 23.0 |
| HAO1-1033 | 1029 | | 44.0 ± 6.7 | 51.2 ± 23.8 | 55.6 ± 14.2 |
| HAO1-1034 | 1030 | | 31.0 ± 7.2 | 28.7 ± 27.0 | 33.2 ± 24.5 |
| HAO1-1035 | 1031 | | 31.5 ± 0.7 | 41.1 ± 5.0 | 45.6 ± 9.9 |
| HAO1-1073 | 1069 | | 22.7 ± 2.9 | 90.8 ± 4.7 | 104.2 ± 12.2 |
| HAO1-1074 | 1070 | | 17.0 ± 1.6 | 125.5 ± 3.4 | 100.0 ± 3.4 |
| HAO1-1075 | 1071 | | 20.6 ± 2.9 | 59.2 ± 5.6 | 52.3 ± 3.3 |
| HAO1-1076 | 1072 | | 36.1 ± 1.1 | 41.0 ± 4.2 | 40.5 ± 8.3 |
| HAO1-1077 | 1073 | | 24.1 ± 3.3 | 88.5 ± 10.3 | 95.9 ± 7.7 |

TABLE 11-continued

Glycolate Oxidase Inhibitory Efficacy of DsiRNAs Assayed at 1 nM in Human HeLa and Mouse HEPA1-6 Cells

| Duplex Name | Mm Location | Macaque* Location | Human - HeLa Human Psi-Check-HsHAO1 Plasmid RLuc Remaining vs. NC1, NC5, NC7 Hs HAO1 Reporter Assay % Remaining | Mouse - Hepa1-6 Normalized HPRT/Rpl23; vs NC1, NC5, NC7 Mm HAO1 476-611 (FAM) Assay % Remaining | Mm HAO1 1775-1888 (HEX) Assay % Remaining |
|---|---|---|---|---|---|
| HAO1-1078 | 1074 | | 29.9 ± 6.6 | 83.1 ± 6.4 | 89.4 ± 9.5 |
| HAO1-1079 | 1075 | | 17.3 ± 2.1 | 41.5 ± 8.4 | 51.3 ± 7.6 |
| HAO1-1080 | 1076 | | 19.8 ± 3.1 | 93.6 ± 8.7 | 105.2 ± 2.7 |
| HAO1-1081 | 1077 | | 20.1 ± 1.4 | 73.7 ± 4.5 | 88.5 ± 4.2 |
| HAO1-1082 | 1078 | | 19.4 ± 4.0 | 131.0 ± 17.3 | 120.9 ± 7.0 |
| HAO1-1083 | 1079 | | 16.7 ± 5.3 | 42.8 ± 14.3 | 46.8 ± 16.5 |
| HAO1-1084 | 1080 | | 22.2 ± 1.8 | 47.7 ± 4.3 | 45.0 ± 3.6 |
| HAO1-1085 | 1081 | 1157 | 23.0 ± 6.7 | 52.4 ± 3.1 | 54.1 ± 2.6 |
| HAO1-1086 | 1082 | 1158 | 17.1 ± 3.4 | 35.8 ± 4.1 | 39.9 ± 4.1 |
| HAO1-1087 | 1083 | 1159 | 19.4 ± 3.3 | 25.3 ± 3.4 | 25.8 ± 7.7 |
| HAO1-1088 | 1084 | 1160 | 17.5 ± 2.1 | 46.7 ± 3.3 | 46.7 ± 4.4 |
| HAO1-1089 | 1085 | 1161 | 21.2 ± 2.5 | 44.8 ± 6.5 | 45.1 ± 8.1 |
| HAO1-1090 | 1086 | 1162 | 19.1 ± 2.8 | 67.8 ± 2.2 | 72.0 ± 4.0 |
| HAO1-1091 | 1087 | 1163 | 21.1 ± 11.9 | 40.8 ± 5.5 | 30.2 ± 9.6 |
| HAO1-1092 | 1088 | 1164 | 22.9 ± 2.5 | 43.2 ± 6.1 | 42.3 ± 7.6 |
| HAO1-1093 | 1089 | 1165 | 18.6 ± 3.5 | 31.2 ± 16.9 | 28.5 ± 15.2 |
| HAO1-1094 | 1090 | 1166 | 20.8 ± 3.3 | 24.4 ± 10.3 | 26.8 ± 4.7 |
| HAO1-1095 | 1091 | 1167 | 16.6 ± 4.1 | 37.6 ± 8.0 | 32.5 ± 18.5 |
| HAO1-1096 | 1092 | 1168 | 25.1 ± 4.3 | 19.0 ± 5.5 | 19.0 ± 7.5 |
| HAO1-1097 | 1093 | 1169 | 67.8 ± 4.1 | 19.8 ± 13.4 | 18.9 ± 2.5 |
| HAO1-1098 | 1094 | 1170 | 50.4 ± 2.6 | 33.3 ± 5.5 | 29.8 ± 1.8 |
| HAO1-1099 | 1095 | 1171 | 32.7 ± 1.4 | 24.6 ± 5.4 | 22.3 ± 4.8 |
| HAO1-1100 | 1096 | 1172 | 29.5 ± 1.0 | 30.3 ± 8.5 | 34.4 ± 9.2 |
| HAO1-1101 | 1097 | 1173 | 51.9 ± 3.4 | 32.5 ± 6.2 | 35.1 ± 6.8 |
| HAO1-1102 | 1098 | 1174 | 40.6 ± 1.4 | 84.1 ± 4.5 | 94.4 ± 8.3 |
| HAO1-1103 | 1099 | 1175 | 38.9 ± 1.7 | 22.6 ± 9.9 | 30.5 ± 12.3 |
| HAO1-1104 | 1100 | 1176 | 68.5 ± 3.8 | 47.6 ± 8.6 | 47.8 ± 8.1 |
| HAO1-1105 | 1101 | 1177 | 36.2 ± 3.8 | 20.1 ± 13.1 | 22.2 ± 25.5 |
| HAO1-1106 | 1102 | 1178 | 49.5 ± 5.9 | 73.7 ± 6.3 | 74.8 ± 4.2 |
| HAO1-1107 | 1103 | 1179 | 35.9 ± 2.5 | 44.9 ± 6.0 | 38.6 ± 18.4 |
| HAO1-1108 | 1104 | 1180 | 35.9 ± 3.0 | 69.0 ± 4.7 | 74.7 ± 10.4 |
| HAO1-1109 | 1105 | 1181 | 30.2 ± 1.9 | 52.0 ± 8.4 | 50.7 ± 7.5 |
| HAO1-1110 | 1106 | 1182 | 34.6 ± 4.6 | 25.1 ± 16.5 | 26.3 ± 7.1 |
| HAO1-1111 | 1107 | 1183 | 26.0 ± 2.3 | 28.5 ± 4.5 | 32.9 ± 5.9 |
| HAO1-1112 | 1108 | 1184 | 34.2 ± 2.3 | 59.4 ± 8.8 | 65.3 ± 7.1 |
| HAO1-1113 | 1109 | 1185 | 32.5 ± 2.1 | 29.3 ± 7.7 | 32.3 ± 12.1 |
| HAO1-1114 | 1110 | 1186 | 39.4 ± 0.7 | 47.6 ± 11.3 | 50.9 ± 10.3 |
| HAO1-1115 | 1111 | 1187 | 23.7 ± 1.6 | 45.0 ± 4.1 | 36.2 ± 5.3 |
| HAO1-1116 | 1112 | 1188 | 28.0 ± 7.1 | 48.3 ± 8.1 | 34.2 ± 5.8 |
| HAO1-1117 | 1113 | 1189 | 29.9 ± 1.4 | 34.3 ± 14.9 | 29.9 ± 13.2 |
| HAO1-1118 | 1114 | 1190 | 29.9 ± 2.8 | 29.1 ± 17.1 | 28.5 ± 15.6 |
| HAO1-1119 | 1115 | 1191 | 36.2 ± 5.1 | 55.9 ± 9.1 | 48.9 ± 14.9 |
| HAO1-1120 | 1116 | 1192 | 37.7 ± 4.0 | 54.1 ± 10.9 | 47.9 ± 6.8 |
| HAO1-1121 | 1117 | 1193 | 26.8 ± 4.3 | 33.4 ± 4.6 | 31.9 ± 14.4 |
| HAO1-1122 | 1118 | 1194 | 27.4 ± 3.0 | 41.3 ± 4.3 | 32.1 ± 4.8 |
| HAO1-1123 | 1119 | 1195 | 27.8 ± 5.4 | 36.4 ± 6.1 | 32.3 ± 3.2 |
| HAO1-1124 | 1120 | 1196 | 30.5 ± 5.2 | 64.6 ± 8.8 | 56.3 ± 9.1 |
| HAO1-1125 | 1121 | 1197 | 33.6 ± 4.2 | 37.6 ± 5.5 | 32.7 ± 12.1 |
| HAO1-1126 | 1122 | 1198 | 26.4 ± 6.7 | 40.9 ± 3.0 | 41.2 ± 2.4 |
| HAO1-1127 | 1123 | 1199 | 74.2 ± 5.1 | 78.6 ± 4.3 | 85.2 ± 5.7 |
| HAO1-1147 | 1143 | 1219 | 38.3 ± 4.1 | 56.8 ± 10.1 | 51.0 ± 13.8 |
| HAO1-1148 | 1144 | 1220 | 36.8 ± 3.9 | 61.0 ± 7.1 | 58.6 ± 7.9 |
| HAO1-1149 | 1145 | 1221 | 27.6 ± 1.5 | 33.6 ± 6.2 | 32.2 ± 0.3 |
| HAO1-1150 | 1146 | 1222 | 34.6 ± 1.1 | 60.2 ± 13.8 | 39.7 ± 8.2 |
| HAO1-1151 | 1147 | 1223 | 36.7 ± 1.3 | 51.3 ± 5.6 | 44.6 ± 5.9 |
| HAO1-1152 | 1148 | 1224 | 35.1 ± 2.5 | 42.7 ± 9.1 | 31.4 ± 10.7 |
| HAO1-1153 | 1149 | 1225 | 32.7 ± 1.6 | 23.3 ± 4.2 | 23.2 ± 11.9 |
| HAO1-1154 | 1150 | 1226 | 21.3 ± 8.3 | 23.2 ± 5.7 | 26.3 ± 5.1 |
| HAO1-1155 | 1151 | 1227 | 30.5 ± 0.9 | 42.0 ± 9.5 | 41.9 ± 7.8 |
| HAO1-1156 | 1152 | 1228 | 27.8 ± 4.0 | 36.4 ± 6.3 | 38.6 ± 10.1 |
| HAO1-1157 | 1153 | 1229 | 28.6 ± 0.9 | 36.8 ± 6.1 | 32.6 ± 5.6 |
| HAO1-1158 | 1154 | 1230 | 30.1 ± 9.0 | 45.3 ± 3.8 | 38.5 ± 8.4 |
| HAO1-1159 | 1155 | 1231 | 26.7 ± 1.5 | 43.8 ± 10.2 | 31.2 ± 4.9 |
| HAO1-1160 | 1156 | 1232 | 45.8 ± 4.1 | 81.7 ± 7.9 | 62.2 ± 14.4 |
| HAO1-1161 | 1157 | 1233 | 42.4 ± 4.2 | 58.7 ± 9.5 | 56.6 ± 10.2 |
| HAO1-1162 | 1158 | 1234 | 24.3 ± 1.9 | 27.4 ± 21.0 | 29.6 ± 16.6 |
| HAO1-1163 | 1159 | 1235 | 22.7 ± 5.2 | 44.7 ± 8.9 | 43.1 ± 9.1 |

TABLE 11-continued

Glycolate Oxidase Inhibitory Efficacy of DsiRNAs Assayed at 1 nM in Human HeLa and Mouse HEPA1-6 Cells

| | | | Human - HeLa Human Psi-Check-HsHAO1 Plasmid RLuc Remaining vs. NC1, NC5, NC7 | Mouse - Hepa1-6 Normalized HPRT/Rpl23; vs NC1, NC5, NC7 | |
|---|---|---|---|---|---|
| Duplex Name | Mm Location | Macaque* Location | Hs HAO1 Reporter Assay % Remaining | Mm HAO1 476-611 (FAM) Assay % Remaining | Mm HAO1 1775-1888 (HEX) Assay % Remaining |
| HAO1-1164 | 1160 | 1236 | 27.6 ± 2.5 | 40.3 ± 9.9 | 35.4 ± 10.2 |
| HAO1-1165 | 1161 | 1237 | 38.4 ± 2.1 | 61.6 ± 3.6 | 52.8 ± 7.7 |
| HAO1-1166 | 1162 | 1238 | 29.9 ± 3.4 | 46.9 ± 5.5 | 44.3 ± 4.8 |
| HAO1-1167 | 1163 | 1239 | 28.7 ± 3.6 | 41.3 ± 4.6 | 41.1 ± 5.7 |
| HAO1-1168 | 1164 | 1240 | 27.9 ± 2.4 | 19.5 ± 10.7 | 12.2 ± 12.8 |
| HAO1-1169 | 1165 | 1241 | 23.2 ± 4.0 | 21.1 ± 5.5 | 17.2 ± 7.4 |
| HAO1-1170 | 1166 | 1242 | 27.3 ± 5.0 | 23.9 ± 8.2 | 25.7 ± 17.1 |
| HAO1-1171 | 1167 | 1243 | 23.4 ± 4.1 | 16.3 ± 9.6 | 15.8 ± 3.2 |
| HAO1-1172 | 1168 | 1244 | 23.8 ± 0.6 | 23.1 ± 6.2 | 21.5 ± 7.8 |
| HAO1-1173 | 1169 | 1245 | 29.3 ± 0.8 | 35.7 ± 6.8 | 36.3 ± 9.4 |
| HAO1-1207 | 1204 | 1280 | 48.6 ± 5.3 | 86.7 ± 21.6 | 52.9 ± 5.6 |
| HAO1-1208 | 1205 | 1281 | 49.5 ± 2.7 | 47.3 ± 8.4 | 40.2 ± 5.8 |
| HAO1-1209 | 1206 | 1282 | 48.9 ± 5.1 | 35.5 ± 4.9 | 29.8 ± 3.9 |
| HAO1-1210 | 1207 | 1283 | 27.8 ± 1.6 | 17.3 ± 13.9 | 19.1 ± 9.6 |
| HAO1-1211 | 1208 | 1284 | 32.3 ± 2.3 | 17.3 ± 5.5 | 21.5 ± 8.1 |
| HAO1-1212 | 1209 | 1285 | 50.6 ± 5.1 | 47.0 ± 1.6 | 48.4 ± 5.7 |
| HAO1-1213 | 1210 | 1286 | 34.6 ± 3.1 | 35.9 ± 4.5 | 36.1 ± 1.9 |
| HAO1-1214 | 1211 | 1287 | 62.1 ± 3.4 | 66.8 ± 6.9 | 62.1 ± 7.6 |
| HAO1-1215 | 1212 | 1288 | 31.0 ± 1.9 | 44.4 ± 24.2 | 34.7 ± 13.4 |
| HAO1-1216 | 1213 | 1289 | 36.9 ± 4.3 | 41.3 ± 41.8 | 53.6 ± 42.5 |
| HAO1-1217 | 1214 | 1290 | 35.0 ± 2.8 | 36.6 ± N/A | 49.8 ± N/A |
| HAO1-1218 | 1215 | 1291 | 41.1 ± 4.0 | 68.6 ± 48.3 | 49.0 ± 11.2 |
| HAO1-1219 | 1216 | 1292 | 30.3 ± 0.6 | 20.3 ± 17.6 | 19.7 ± 26.5 |
| HAO1-1220 | 1217 | 1293 | 46.2 ± 2.9 | 74.7 ± 37.9 | 58.7 ± 20.3 |
| HAO1-1221 | 1218 | 1294 | 25.6 ± 5.1 | 12.2 ± 26.8 | 16.4 ± 9.8 |
| HAO1-1222 | 1219 | 1295 | 33.8 ± 8.7 | 25.7 ± 24.9 | 23.6 ± 1.8 |
| HAO1-1223 | 1220 | 1296 | 47.9 ± 3.7 | 59.1 ± 22.4 | 48.4 ± 5.4 |
| HAO1-1224 | 1221 | 1297 | 27.7 ± 3.5 | 32.8 ± 27.9 | 46.4 ± 25.0 |
| HAO1-1225 | 1222 | 1298 | 64.0 ± 3.0 | 51.3 ± N/A | 63.2 ± N/A |
| HAO1-1226 | 1223 | 1299 | 38.8 ± 6.2 | 14.0 ± 17.6 | 23.1 ± 5.6 |
| HAO1-1227 | 1224 | 1300 | 44.1 ± 3.8 | N/A ± N/A | N/A ± N/A |
| HAO1-1228 | 1225 | 1301 | 60.2 ± 5.5 | 24.2 ± 14.9 | 44.7 ± 15.4 |
| HAO1-1266 | 1263 | | 20.7 ± 4.9 | 20.4 ± 30.4 | 30.2 ± 7.1 |
| HAO1-1267 | 1264 | | 26.5 ± 7.3 | 20.0 ± 4.6 | 21.9 ± 6.2 |
| HAO1-1268 | 1265 | | 27.5 ± 5.0 | 23.4 ± 13.9 | 25.1 ± 11.0 |
| HAO1-1269 | 1266 | | 23.6 ± 2.8 | 86.3 ± 21.3 | 29.8 ± 7.7 |
| HAO1-1270 | 1267 | | 30.9 ± 0.7 | 100.0 ± 48.0 | 32.0 ± 10.7 |
| HAO1-1271 | 1268 | | 24.9 ± 5.9 | N/A ± N/A | N/A ± N/A |
| HAO1-1272 | 1269 | | 18.7 ± 1.3 | 8.0 ± N/A | 12.3 ± N/A |
| HAO1-1273 | 1270 | | 23.1 ± 1.7 | 9.0 ± 11.8 | 10.8 ± 27.6 |
| HAO1-1274 | 1271 | | 25.4 ± 4.5 | 38.3 ± 54.0 | 25.4 ± 6.4 |
| HAO1-1275 | 1272 | | 25.6 ± 2.9 | 17.2 ± 6.0 | 20.0 ± 6.3 |
| HAO1-1276 | 1273 | 1349 | 26.4 ± 3.2 | 29.2 ± 13.8 | 22.3 ± 9.5 |
| HAO1-1277 | 1274 | 1350 | 24.7 ± 4.6 | 35.4 ± 3.6 | 30.3 ± 9.3 |
| HAO1-1278 | 1275 | 1351 | 24.0 ± 1.3 | 24.7 ± 8.8 | 17.1 ± 17.3 |
| HAO1-1279 | 1276 | 1352 | 22.1 ± 2.2 | 19.3 ± 10.6 | 19.8 ± 9.1 |
| HAO1-1280 | 1277 | 1353 | 25.0 ± 2.5 | 35.5 ± 11.2 | 29.5 ± 5.9 |
| HAO1-1281 | 1278 | 1354 | 27.3 ± 1.7 | 37.7 ± 11.3 | 33.0 ± 18.2 |
| HAO1-1282 | 1279 | 1355 | 23.6 ± 3.3 | 32.2 ± 6.4 | 33.4 ± 10.4 |
| HAO1-1313 | 1310 | 1386 | 32.5 ± 7.9 | 47.6 ± 3.4 | 46.9 ± 3.5 |
| HAO1-1314 | 1311 | 1387 | 18.2 ± 2.1 | 24.3 ± 15.9 | 17.9 ± 15.4 |
| HAO1-1315 | 1312 | 1388 | 16.2 ± 0.6 | 24.9 ± 11.2 | 15.0 ± 11.1 |
| HAO1-1316 | 1313 | 1389 | 17.1 ± 5.3 | 18.9 ± 4.2 | 12.6 ± 20.2 |
| HAO1-1317 | 1314 | 1390 | 20.9 ± 4.0 | 20.2 ± 4.5 | 20.7 ± 7.2 |
| HAO1-1318 | 1315 | 1391 | 32.7 ± 1.6 | 44.2 ± 9.3 | 38.6 ± 3.0 |
| HAO1-1319 | 1316 | 1392 | 33.7 ± 5.3 | 42.1 ± 14.2 | 42.5 ± 18.8 |
| HAO1-1320 | 1317 | 1393 | 21.3 ± 3.0 | 24.0 ± 10.3 | 26.8 ± 8.4 |
| HAO1-1321 | 1318 | 1394 | 29.6 ± 4.7 | 47.3 ± 6.3 | 57.1 ± 6.4 |
| HAO1-1322 | 1319 | 1395 | 22.0 ± 1.4 | 27.9 ± 19.7 | 30.7 ± 4.5 |
| HAO1-1323 | 1320 | 1396 | 34.7 ± 3.2 | 61.3 ± 3.2 | 59.9 ± 3.6 |
| HAO1-1324 | 1321 | 1397 | 40.9 ± 1.6 | 65.7 ± 11.9 | 57.4 ± 17.9 |
| HAO1-1325 | 1322 | 1398 | 38.3 ± 2.2 | 45.5 ± 11.4 | 43.0 ± 26.3 |
| HAO1-1326 | 1323 | 1399 | 24.4 ± 2.5 | 19.0 ± 7.0 | 19.8 ± 4.0 |
| HAO1-1327 | 1324 | 1400 | 25.9 ± 2.9 | 19.1 ± 7.0 | 16.3 ± 10.0 |
| HAO1-1328 | 1325 | 1401 | 53.5 ± 6.4 | 46.6 ± 5.6 | 58.5 ± 5.7 |
| HAO1-1329 | 1326 | 1402 | 26.0 ± 4.1 | 23.3 ± 6.5 | 26.6 ± 2.9 |
| HAO1-1330 | 1327 | 1403 | 28.1 ± 10.3 | 27.5 ± 9.7 | 19.5 ± 11.5 |

TABLE 11-continued

Glycolate Oxidase Inhibitory Efficacy of DsiRNAs Assayed at 1 nM in Human HeLa and Mouse HEPA1-6 Cells

| | | | Human - HeLa Human Psi-Check-HsHAO1 Plasmid RLuc Remaining vs. NC1, NC5, NC7 | Mouse - Hepa1-6 Normalized HPRT/Rpl23; vs NC1, NC5, NC7 | |
|---|---|---|---|---|---|
| Duplex Name | Mm Location | Macaque* Location | Hs HAO1 Reporter Assay % Remaining | Mm HAO1 476-611 (FAM) Assay % Remaining | Mm HAO1 1775-1888 (HEX) Assay % Remaining |
| HAO1-1331 | 1328 | 1404 | 26.5 ± 2.9 | 34.6 ± 12.9 | 24.4 ± 6.6 |
| HAO1-1332 | 1329 | 1405 | 25.5 ± 3.3 | 28.6 ± 24.6 | 22.8 ± 18.7 |
| HAO1-1333 | 1330 | 1406 | 23.3 ± 1.7 | 22.4 ± 9.8 | 19.3 ± 17.6 |
| HAO1-1334 | 1331 | 1407 | 29.6 ± 3.4 | 25.8 ± 18.2 | 24.2 ± 17.6 |
| HAO1-1335 | 1332 | 1408 | 24.5 ± 0.4 | 21.2 ± 14.4 | 21.2 ± 14.0 |
| HAO1-1373 | 1370 | 1446 | 30.2 ± 6.0 | 36.4 ± 7.4 | 31.7 ± 12.2 |
| HAO1-1374 | 1371 | 1447 | 25.4 ± 2.4 | 25.6 ± 5.3 | 17.5 ± 13.3 |
| HAO1-1375 | 1372 | 1448 | 19.1 ± 4.9 | 20.7 ± 9.2 | 17.7 ± 14.4 |
| HAO1-1376 | 1373 | 1449 | 22.5 ± 1.7 | 20.6 ± 4.3 | 18.5 ± 2.6 |
| HAO1-1377 | 1374 | 1450 | 22.6 ± 7.0 | 23.8 ± 11.4 | 20.9 ± 19.7 |
| HAO1-1378 | 1375 | 1451 | 19.8 ± 4.3 | 13.9 ± 4.2 | 12.4 ± 8.5 |
| HAO1-1379 | 1376 | 1452 | 18.5 ± 3.2 | 14.6 ± 5.7 | 14.7 ± 4.1 |
| HAO1-1380 | 1377 | 1453 | 21.6 ± 5.8 | 22.9 ± 5.0 | 22.9 ± 3.7 |
| HAO1-1381 | 1378 | 1454 | 24.9 ± 3.4 | 26.8 ± 7.4 | 29.6 ± 10.0 |
| HAO1-1382 | 1379 | 1455 | 24.1 ± 4.6 | 26.1 ± 15.4 | 21.7 ± 9.3 |
| HAO1-1383 | 1380 | 1456 | 26.1 ± 1.1 | 45.1 ± 27.8 | 23.9 ± 16.7 |
| HAO1-1384 | 1381 | 1457 | 25.2 ± 8.3 | 36.9 ± 14.1 | 32.1 ± 8.3 |
| HAO1-1385 | 1382 | 1458 | 21.6 ± 2.7 | 23.7 ± 6.7 | 17.7 ± 9.1 |
| HAO1-1386 | 1383 | 1459 | 28.2 ± 4.2 | 31.7 ± 2.4 | 30.1 ± 18.3 |
| HAO1-1387 | 1384 | 1460 | 31.0 ± 1.4 | 37.6 ± 7.8 | 39.4 ± 1.8 |
| HAO1-1388 | 1385 | 1461 | 33.6 ± 1.6 | 40.2 ± 4.1 | 49.7 ± 10.3 |
| HAO1-1389 | 1386 | 1462 | 33.8 ± 1.3 | 40.0 ± 7.5 | 41.1 ± 3.7 |
| HAO1-1390 | 1387 | 1463 | 55.4 ± 6.1 | 69.1 ± 4.3 | 53.9 ± 10.0 |
| HAO1-1391 | 1388 | 1464 | 28.1 ± 10.3 | 32.0 ± 6.1 | 21.5 ± 5.8 |
| HAO1-1392 | 1389 | 1465 | 26.5 ± 2.9 | 28.7 ± 13.2 | 20.7 ± 25.5 |
| HAO1-1393 | 1390 | 1466 | 25.5 ± 3.3 | 23.0 ± 21.0 | 13.3 ± 35.8 |
| HAO1-1394 | 1391 | 1467 | 23.3 ± 1.7 | 32.7 ± 17.1 | 35.5 ± 21.3 |
| HAO1-1395 | 1392 | 1468 | 29.6 ± 3.4 | 42.7 ± 16.7 | 42.0 ± 5.0 |
| HAO1-1426 | 1423 | | 24.5 ± 0.4 | 79.5 ± 6.4 | 86.6 ± 5.4 |
| HAO1-1427 | 1424 | | 30.2 ± 6.0 | 88.6 ± 9.8 | 85.6 ± 21.4 |
| HAO1-1428 | 1425 | | 25.4 ± 2.4 | 84.3 ± 4.2 | 58.9 ± 17.0 |
| HAO1-1429 | 1426 | | 19.1 ± 4.9 | 69.0 ± 3.8 | 51.8 ± 6.6 |
| HAO1-1430 | 1427 | | 22.5 ± 1.7 | 92.6 ± 4.9 | 80.4 ± 8.6 |
| HAO1-1431 | 1428 | | 22.6 ± 7.0 | 49.2 ± 10.7 | 40.3 ± 23.4 |
| HAO1-1432 | 1429 | | 19.8 ± 4.3 | 108.3 ± 3.4 | 143.8 ± 5.0 |
| HAO1-1433 | 1430 | | 18.5 ± 3.2 | 47.7 ± 17.1 | 58.3 ± 25.2 |
| HAO1-1434 | 1431 | | 21.6 ± 5.8 | 88.3 ± 0.7 | 111.8 ± 10.3 |
| HAO1-1435 | 1432 | | 24.9 ± 3.4 | 102.7 ± 2.7 | 119.3 ± 3.2 |
| HAO1-1436 | 1433 | | 24.1 ± 4.6 | 106.3 ± 11.1 | 85.7 ± 6.0 |
| HAO1-1437 | 1434 | | 26.1 ± 1.1 | 60.6 ± 14.5 | 74.4 ± 39.2 |
| HAO1-1438 | 1435 | | 25.2 ± 8.3 | 87.4 ± 5.4 | 88.5 ± 1.7 |
| HAO1-59 | | 131 | 21.6 ± 2.7 | 92.2 ± 5.2 | 101.2 ± 12.5 |
| HAO1-60 | | 132 | 28.2 ± 4.2 | 105.6 ± 16.4 | 110.7 ± 16.4 |
| HAO1-61 | | 133 | 31.0 ± 1.4 | 104.8 ± 3.9 | 112.6 ± 3.7 |
| HAO1-62 | | 134 | 33.6 ± 1.6 | 113.9 ± 9.4 | 141.5 ± 11.6 |
| HAO1-63 | | 135 | 33.8 ± 1.3 | 116.1 ± 3.9 | 136.4 ± 10.3 |
| HAO1-64 | | 136 | 55.4 ± 6.1 | 133.5 ± 6.3 | 107.4 ± 8.6 |
| HAO1-65 | | | 8.1 ± 10.5 | | |
| HAO1-66 | | | 12.2 ± 3.5 | | |
| HAO1-67 | | | 11.0 ± 3.2 | | |
| HAO1-68 | | | 17.4 ± 5.0 | | |
| HAO1-70 | | | 14.6 ± 5.5 | | |
| HAO1-71 | | | 17.0 ± 1.0 | | |
| HAO1-72 | | | 13.4 ± 2.0 | | |
| HAO1-73 | | | 11.8 ± 1.0 | | |
| HAO1-74 | | | 19.6 ± 4.8 | | |
| HAO1-75 | | | 16.3 ± 2.3 | | |
| HAO1-76 | | | 20.5 ± 3.2 | | |
| HAO1-77 | | | 17.2 ± 3.0 | | |
| HAO1-80 | | | 14.0 ± 1.6 | | |
| HAO1-82 | | | 22.5 ± 1.3 | | |
| HAO1-83 | | | 13.7 ± 0.9 | | |
| HAO1-86 | | | 15.0 ± 1.5 | | |
| HAO1-95 | | | 18.1 ± 6.2 | | |
| HAO1-96 | | | 18.0 ± 5.0 | | |
| HAO1-98 | | | 21.3 ± 8.4 | | |
| HAO1-99 | | | 19.6 ± 5.3 | | |

TABLE 11-continued

Glycolate Oxidase Inhibitory Efficacy of DsiRNAs Assayed at 1 nM in Human HeLa and Mouse HEPA1-6 Cells

| | | | Human - HeLa Human Psi-Check-HsHAO1 Plasmid RLuc Remaining vs. NC1, NC5, NC7 | Mouse - Hepa1-6 Normalized HPRT/Rpl23; vs NC1, NC5, NC7 | |
|---|---|---|---|---|---|
| Duplex Name | Mm Location | Macaque* Location | Hs HAO1 Reporter Assay % Remaining | Mm HAO1 476-611 (FAM) Assay % Remaining | Mm HAO1 1775-1888 (HEX) Assay % Remaining |
| HAO1-100 | | | 21.7 ± 1.2 | | |
| HAO1-103 | | | 23.3 ± 0.5 | | |
| HAO1-106 | | | 22.9 ± 4.7 | | |
| HAO1-107 | | | 18.4 ± 11.5 | | |
| HAO1-109 | | | 8.1 ± 10.5 | | |
| HAO1-212 | | | 12.2 ± 3.5 | | |
| HAO1-585 | | | 11.0 ± 3.2 | | |
| HAO1-586 | | | 17.4 ± 5.0 | | |
| HAO1-587 | | | 14.6 ± 5.5 | | |
| HAO1-589 | | | 17.0 ± 1.0 | | |
| HAO1-590 | | | 13.4 ± 2.0 | | |
| HAO1-591 | | | 11.8 ± 1.0 | | |
| HAO1-592 | | | 19.6 ± 4.8 | | |
| HAO1-594 | | | 16.3 ± 2.3 | | |
| HAO1-595 | | | 20.5 ± 3.2 | | |
| HAO1-596 | | | 17.2 ± 3.0 | | |
| HAO1-597 | | | 14.0 ± 1.6 | | |
| HAO1-598 | | | 22.5 ± 1.3 | | |
| HAO1-599 | | | 13.7 ± 0.9 | | |
| HAO1-600 | | | 15.0 ± 1.5 | | |
| HAO1-601 | | | 18.1 ± 6.2 | | |
| HAO1-602 | | | 18.0 ± 5.0 | | |
| HAO1-603 | | | 21.3 ± 8.4 | | |
| HAO1-604 | | | 19.6 ± 5.3 | | |
| HAO1-605 | | | 21.7 ± 1.2 | | |
| HAO1-606 | | | 23.3 ± 0.5 | | |
| HAO1-607 | | | 22.9 ± 4.7 | | |
| HAO1-608 | | | 21.6 ± 15.8 | | |
| HAO1-609 | | | 27.7 ± 2.4 | | |
| HAO1-611 | | | 46.6 ± 1.5 | | |
| HAO1-612 | | | 47.5 ± 4.4 | | |
| HAO1-621 | | | 41.0 ± 2.8 | | |
| HAO1-716 | | | 30.0 ± 4.4 | | |
| HAO1-857 | | | 31.3 ± 2.1 | | |
| HAO1-860 | | | 21.4 ± 2.0 | | |
| HAO1-861 | | | 16.6 ± 2.8 | | |
| HAO1-1194 | | | 22.0 ± 2.2 | | |
| HAO1-1195 | | | 36.5 ± 0.8 | | |
| HAO1-1196 | | | 25.3 ± 5.7 | | |
| HAO1-1197 | | | 29.8 ± 5.3 | | |
| HAO1-1198 | | | 17.7 ± 0.4 | | |
| HAO1-1199 | | | 19.7 ± 4.3 | | |
| HAO1-1200 | | | 20.4 ± 2.3 | | |
| HAO1-1201 | | | 19.6 ± 2.9 | | |
| HAO1-1202 | | | 17.0 ± 2.1 | | |
| HAO1-1206 | | | 22.8 ± 1.5 | | |
| HAO1-1246 | | | 22.6 ± 6.0 | | |
| HAO1-1247 | | | 17.0 ± 2.3 | | |
| HAO1-1248 | | | 18.8 ± 2.3 | | |
| HAO1-1249 | | | 18.0 ± 2.4 | | |
| HAO1-1289 | | | 21.1 ± 2.7 | | |
| HAO1-1290 | | | 19.1 ± 2.2 | | |
| HAO1-1291 | | | 24.8 ± 5.1 | | |
| HAO1-1292 | | | 19.4 ± 3.4 | | |
| HAO1-1293 | | | 21.8 ± 2.7 | | |
| HAO1-1362 | | | 24.6 ± 1.8 | | |
| HAO1-1363 | | | 27.1 ± 4.7 | | |
| HAO1-1364 | | | 24.0 ± 1.0 | | |
| HAO1-1365 | | | 29.7 ± 1.5 | | |
| HAO1-1366 | | | 29.2 ± 4.4 | | |
| HAO1-1367 | | | 30.4 ± 3.9 | | |
| HAO1-1368 | | | 28.4 ± 4.3 | | |
| HAO1-1369 | | | 25.6 ± 2.9 | | |
| HAO1-1370 | | | 26.5 ± 4.6 | | |
| HAO1-1371 | | | 18.5 ± 4.6 | | |
| HAO1-1372 | | | 22.3 ± 3.3 | | |
| HAO1-1478 | | | 24.8 ± 3.1 | | |

TABLE 11-continued

Glycolate Oxidase Inhibitory Efficacy of DsiRNAs Assayed at 1 nM in Human HeLa and Mouse HEPA1-6 Cells

| Duplex Name | Mm Location | Macaque* Location | Human - HeLa Human Psi-Check-HsHAO1 Plasmid RLuc Remaining vs. NC1, NC5, NC7 | Mouse - Hepa1-6 Normalized HPRT/Rpl23; vs NC1, NC5, NC7 | |
|---|---|---|---|---|---|
| | | | Hs HAO1 Reporter Assay % Remaining | Mm HAO1 476-611 (FAM) Assay % Remaining | Mm HAO1 1775-1888 (HEX) Assay % Remaining |
| HAO1-1479 | | | 20.7 ± 3.5 | | |
| HAO1-1480 | | | 18.5 ± 2.3 | | |
| HAO1-1481 | | | 24.4 ± 3.3 | | |
| HAO1-1483 | | | 25.0 ± 3.7 | | |
| HAO1-1484 | | | 24.4 ± 2.2 | | |
| HAO1-1488 | | | 18.5 ± 2.7 | | |
| HAO1-1489 | | | 16.1 ± 1.7 | | |
| HAO1-1490 | | | 14.1 ± 3.6 | | |
| HAO1-1491 | | | 14.0 ± 8.6 | | |
| HAO1-1492 | | | 17.5 ± 1.5 | | |
| HAO1-1493 | | | 17.6 ± 2.9 | | |
| HAO1-1494 | | | 15.9 ± 7.5 | | |
| HAO1-1495 | | | 19.3 ± 2.4 | | |
| HAO1-1496 | | | 15.6 ± 4.8 | | |
| HAO1-1497 | | | 16.5 ± 6.0 | | |
| HAO1-1498 | | | 19.7 ± 2.2 | | |
| HAO1-1499 | | | 15.6 ± 4.4 | | |
| HAO1-1500 | | | 15.3 ± 0.2 | | |
| HAO1-1501 | | | 15.6 ± 2.6 | | |
| HAO1-1502 | | | 18.4 ± 1.3 | | |
| HAO1-1503 | | | 18.7 ± 2.3 | | |
| HAO1-1504 | | | 14.6 ± 1.7 | | |
| HAO1-1505 | | | 19.8 ± 2.1 | | |
| HAO1-1506 | | | 34.9 ± 3.4 | | |
| HAO1-1507 | | | 16.2 ± 1.6 | | |
| HAO1-1508 | | | 21.7 ± 2.5 | | |
| HAO1-1509 | | | 30.5 ± 4.2 | | |
| HAO1-1510 | | | 14.7 ± 1.1 | | |
| HAO1-1511 | | | 15.8 ± 0.8 | | |
| HAO1-1512 | | | 14.7 ± 2.9 | | |
| HAO1-1515 | | | 17.7 ± 3.4 | | |
| HAO1-1516 | | | 26.8 ± 4.4 | | |
| HAO1-1519 | | | 22.0 ± 1.5 | | |
| HAO1-1520 | | | 23.3 ± 4.2 | | |
| HAO1-1546 | | | 17.0 ± 3.9 | | |
| HAO1-1547 | | | 19.6 ± 1.8 | | |
| HAO1-1548 | | | 16.9 ± 3.0 | | |
| HAO1-1549 | | | 16.3 ± 2.3 | | |
| HAO1-1550 | | | 19.9 ± 4.6 | | |
| HAO1-1551 | | | 24.3 ± 0.3 | | |
| HAO1-1552 | | | 18.5 ± 0.8 | | |
| HAO1-1557 | | | 16.4 ± 1.3 | | |
| HAO1-1560 | | | 22.1 ± 3.7 | | |
| HAO1-1561 | | | 16.8 ± 3.4 | | |
| HAO1-1563 | | | 16.8 ± 2.4 | | |
| HAO1-1564 | | | 19.0 ± 2.1 | | |
| HAO1-1565 | | | 18.8 ± 1.7 | | |
| HAO1-1656 | | | 18.7 ± 0.4 | | |
| HAO1-1685 | | | 16.0 ± 2.9 | | |
| HAO1-1695 | | | 19.9 ± 5.2 | | |
| HAO1-1696 | | | 15.3 ± 2.1 | | |
| HAO1-1697 | | | 17.9 ± 5.9 | | |
| HAO1-1699 | | | 25.2 ± 1.6 | | |
| HAO1-1700 | | | 19.8 ± 1.8 | | |
| HAO1-1701 | | | 19.9 ± 5.6 | | |
| HAO1-1702 | | | 20.4 ± 1.0 | | |
| HAO1-1703 | | | 17.1 ± 0.7 | | |

*Macaca mulatta*

Figure 3A:
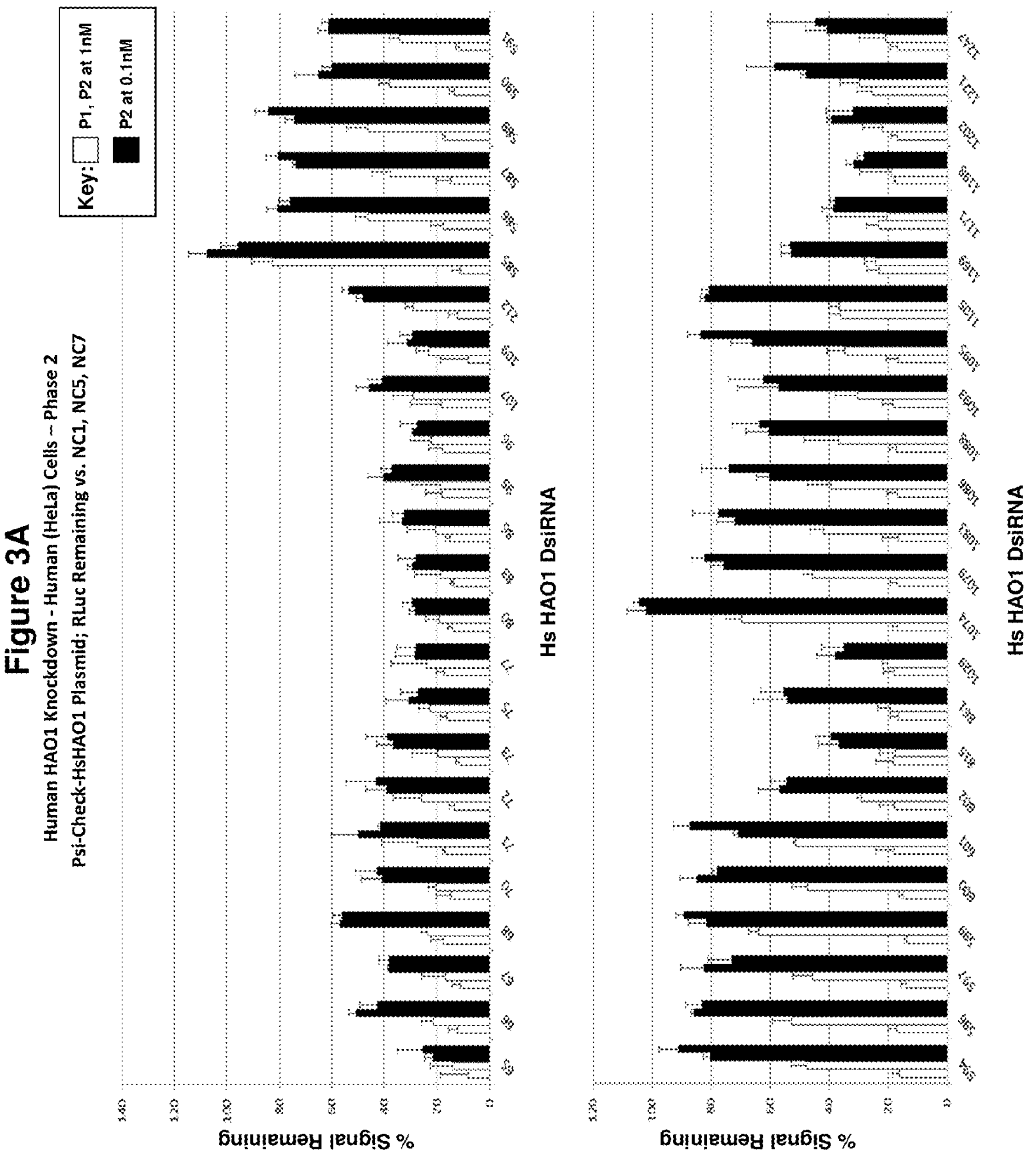
FIGS. 3A to 3F show histograms of human and mouse Glycolate Oxidase inhibitory efficacies observed for indicated DsiRNAs. "P1" indicates phase 1 (primary screen), while "P2" indicates phase 2. In phase 1, DsiRNAs were tested at 1 nM in the environment of HeLa cells (human cell assays.
Figure 3B:
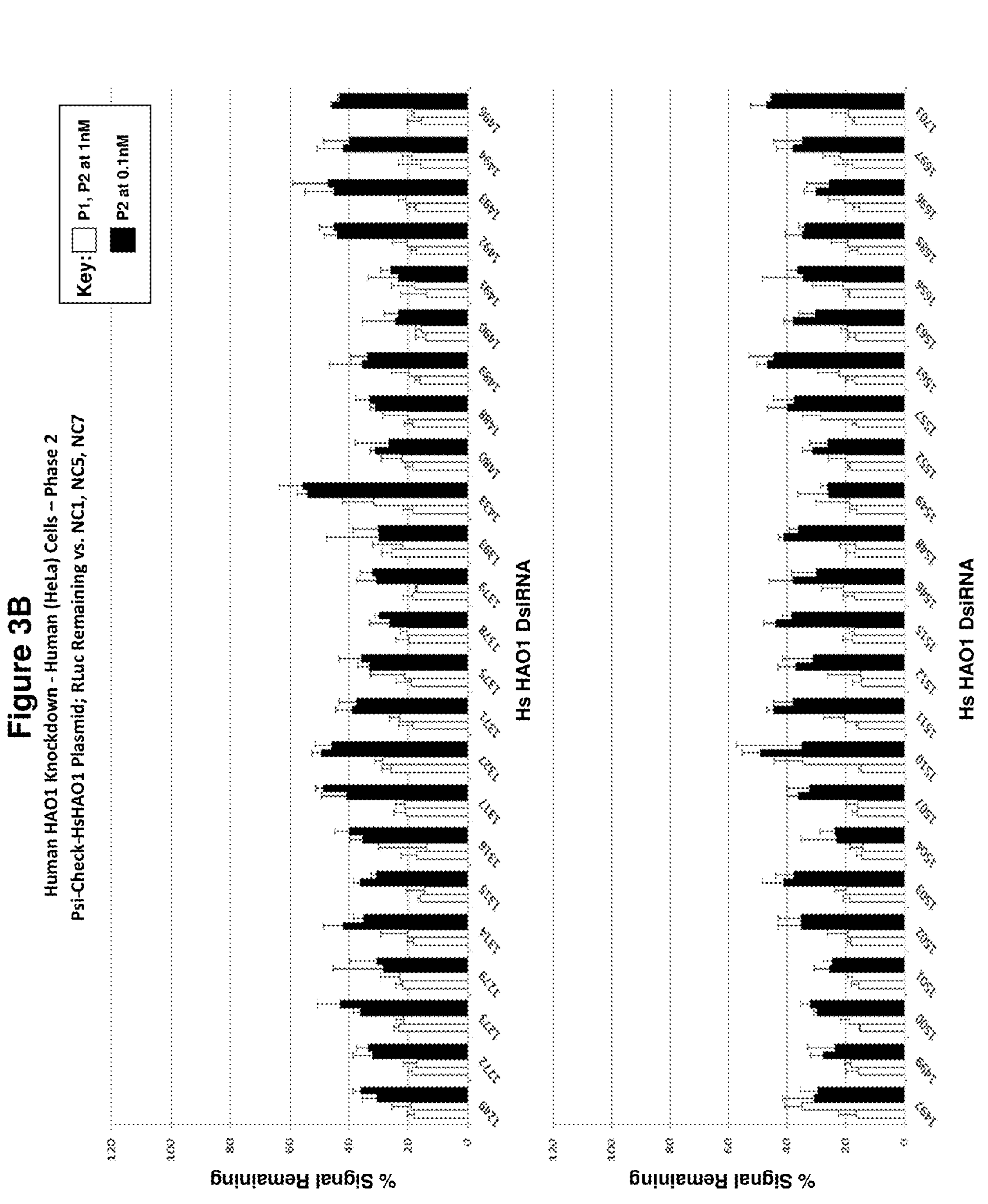
Figure 3C:
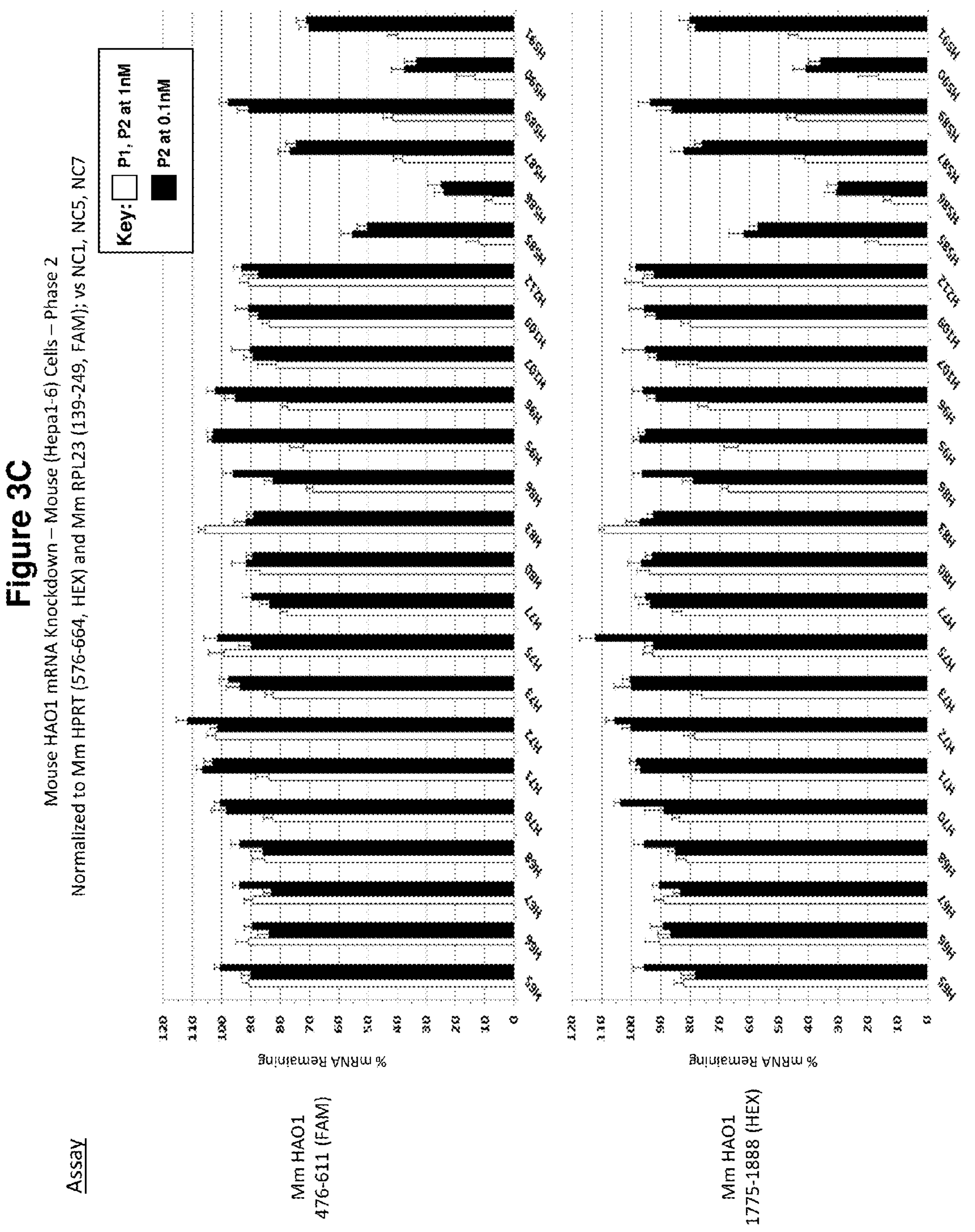
Figure 3D:
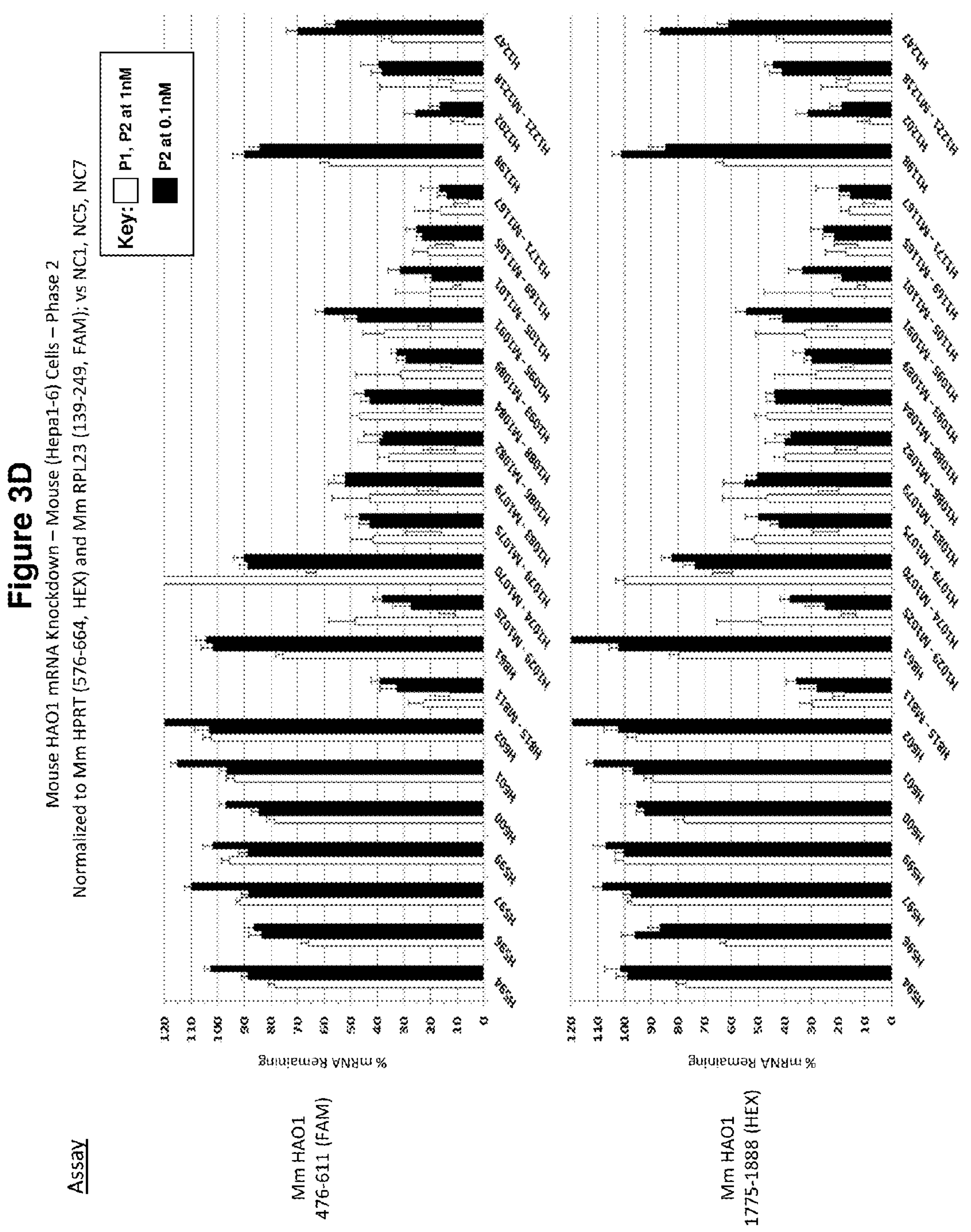
Figure 3E:
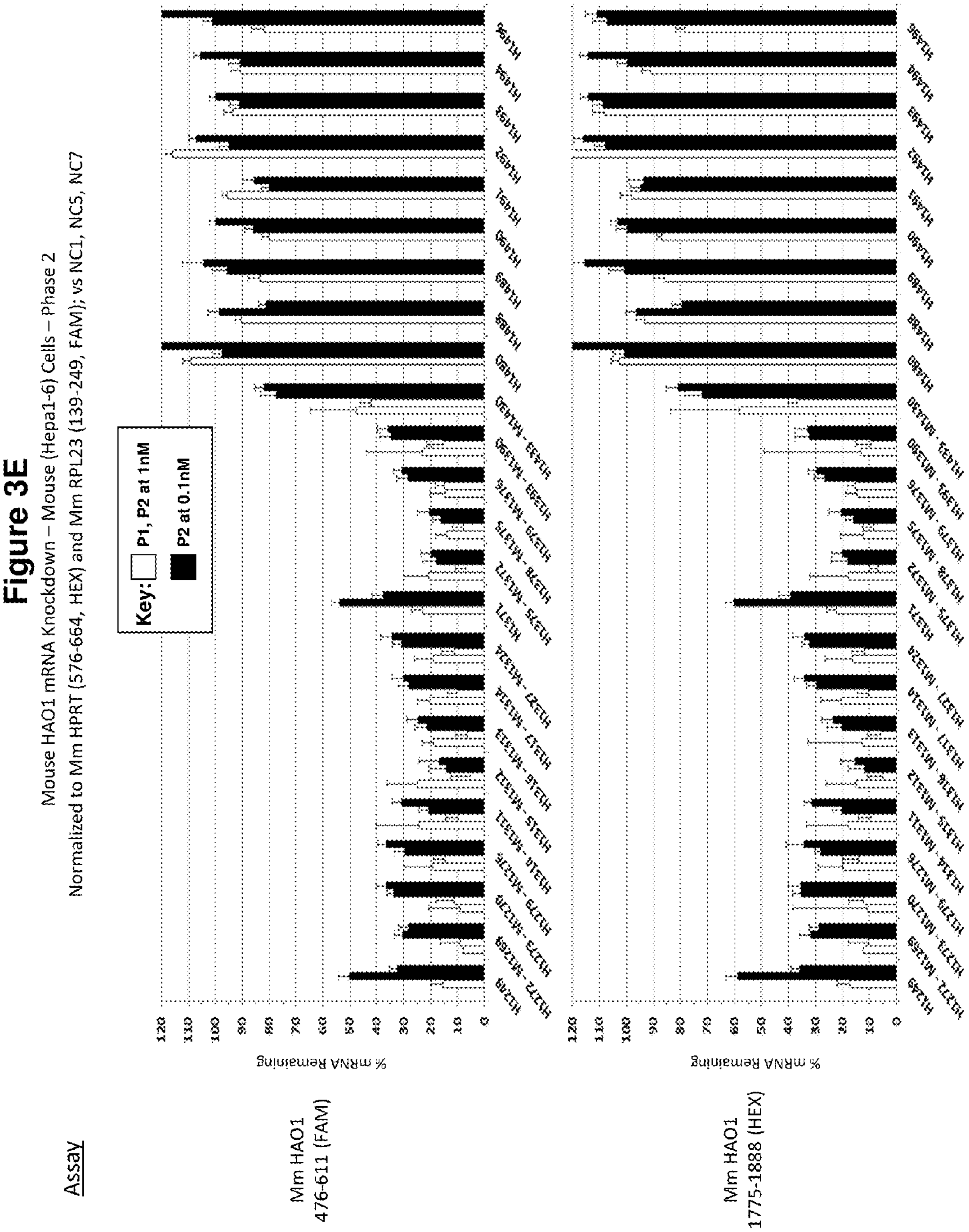
Figure 3F:
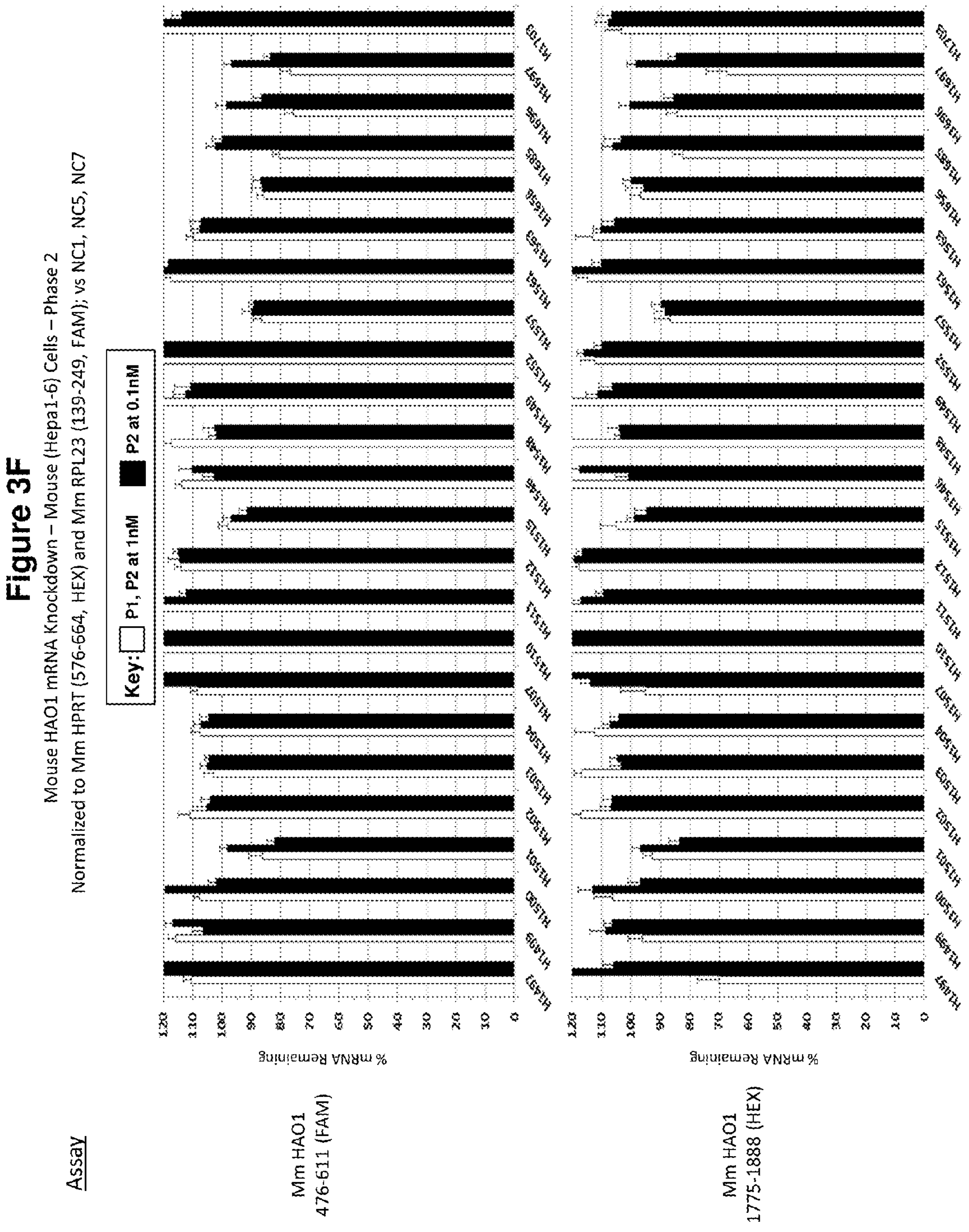

Example 3: DsiRNA Inhibition of Glycolate Oxidase—Secondary Screen 96 asymmetric DsiRNAs (96 targeting Hs HAO1, 26 of which also targeted Mm HAO1) of the above experiment were then examined in a secondary assay ("Phase 2"), with results of such assays presented in histogram form in FIGS. 3A to 3F. Specifically, the 96 asymmetric DsiRNAs selected from those tested above were assessed for inhibition of human HAO1 at 1 nM or 0.1 nM (in duplicate assays) in the environment of human HeLa cells (FIGS. 3A and 3B). These 96 asymmetric DsiRNAs were also assessed for inhibition of mouse HAO1 at 1 nM or 0.1 nM (in duplicate) in the environment of mouse Hepal-6 cells (FIGS. 3C to 3F). As shown in FIGS. 3A and 3B, most asymmetric DsiRNAs reproducibly exhibited significant human HAO1 inhibitory efficacies at sub-nanomolar concentrations when assayed in the environment of HeLa cells.

Without being bound by theory, it is noted that when using the RT-qPCR method to measure the amount of mRNA remaining after DsiRNA-mediated mRNA knockdown, the position of the qPCR assay within the mRNA can affect the detection of knockdown. The qPCR assay that is closer to the DsiRNA-directed mRNA cleavage point usually yields a more reliable measurement of mRNA level. For example, if a qPCR assay is located away from the cleavage point, slow degradation of the mRNA fragment resulting from DsiRNA-directed cleavage can yield an artifactual high qPCR signal (a 'false negative' for knockdown). A sign of this is high knockdown detected using a qPCR assay located near the DsiRNA site, and artifactual 'low' knockdown detected with a qPCR assay located away from the DsiRNA site. In this situation, the qPCR assay near the DsiRNA site is used for quantitation.

As shown in FIGS. 3C to 3F, a number of asymmetric DsiRNAs were also identified to possess significant mouse HAO1 inhibitory efficacies at sub-nanomolar concentrations when assayed in the environment of mouse Hepal-6 cells.

Figure 4:
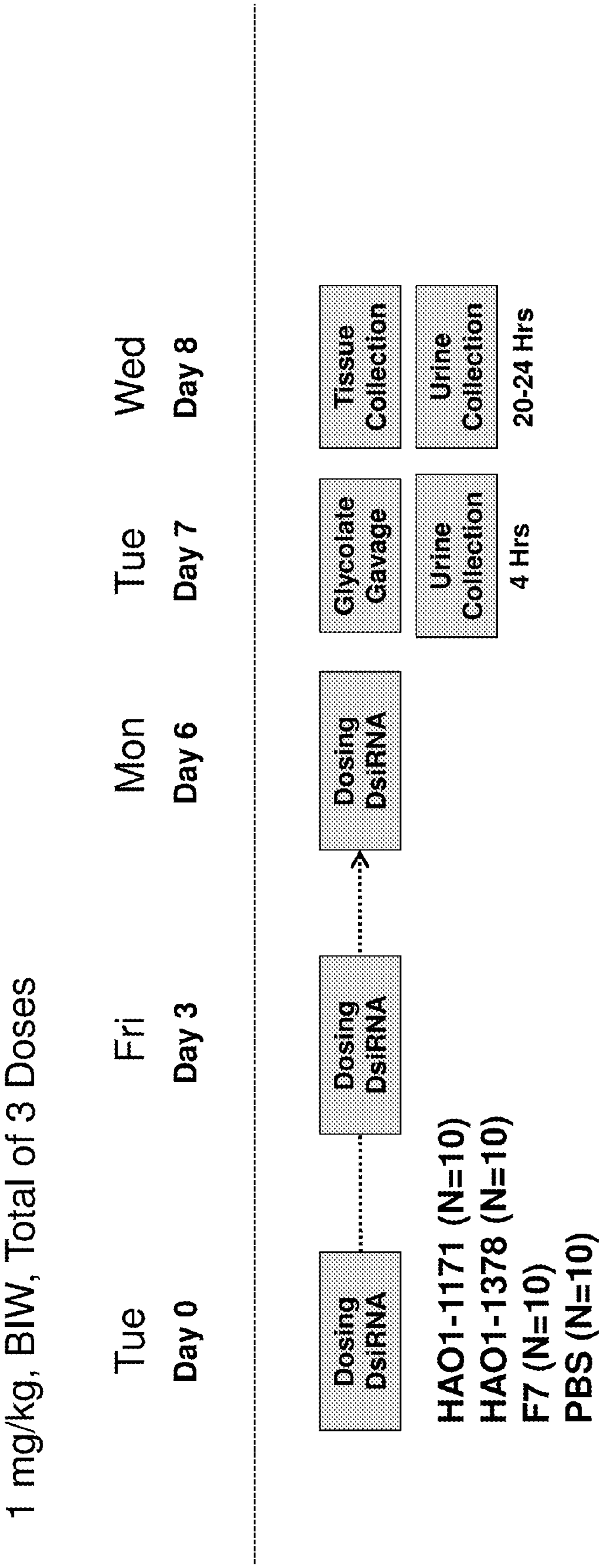
FIG. 4 shows a flow chart for initial in vivo mouse experiments, which included glycolate challenge.
Figure 5:
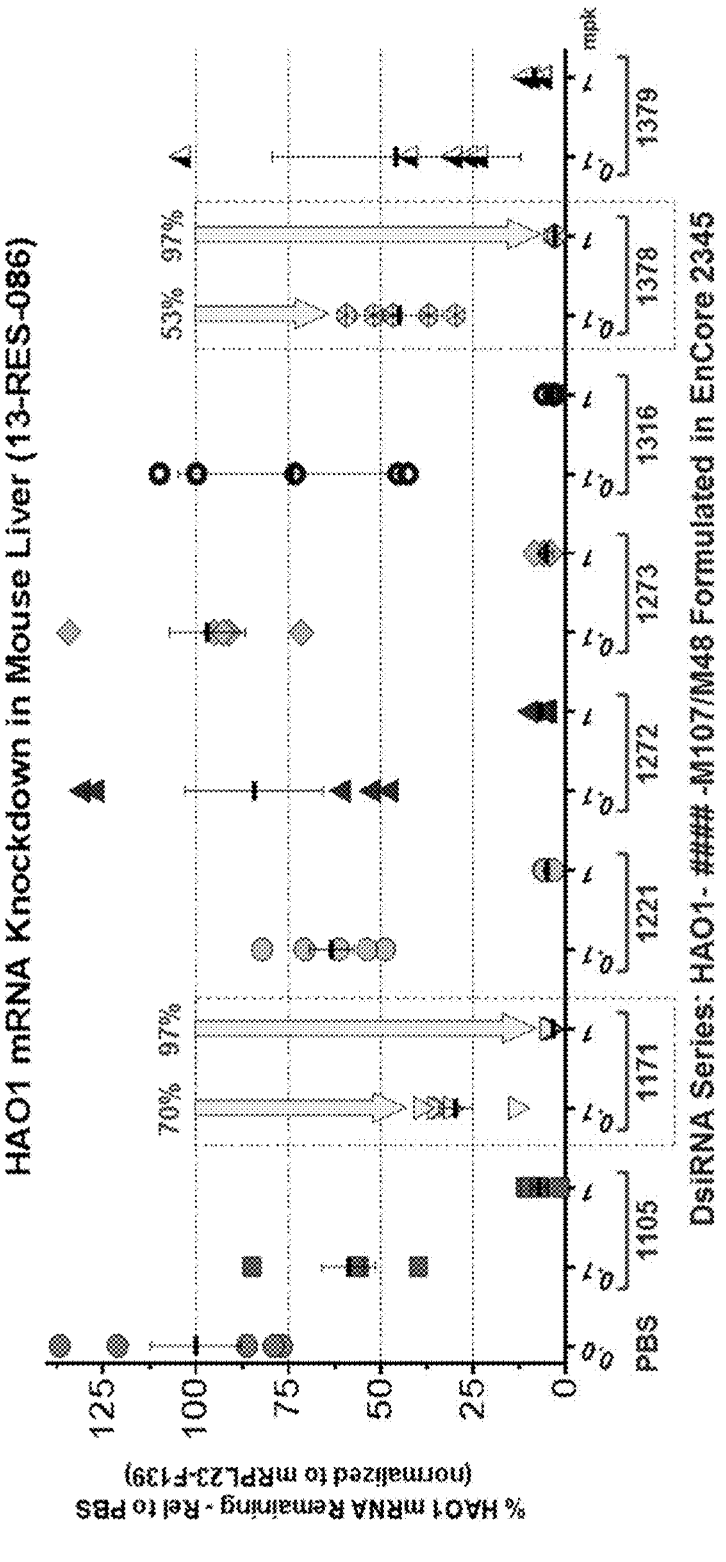
FIG. 5 shows HAO1 knockdown in mouse liver for animals administered 0.1 mg/kg or 1 mg/kg of indicated HAO1-targeting DsiRNAs formulated in LNP (here, LNP EnCore 2345).

Example 4: Assessment of In Vivo Efficacy of Glycolate Oxidase-Targeting DsiRNAs The ability of certain, active HAO1-targeting DsiRNAs to reduce HAO1 levels within the liver of a mouse was examined. DsiRNAs employed in the study were: HAO1-1105, HAO1-1171, HAO1-1221, HAO1-1272, HAO1-1273, HAO1-1316, HAO1-1378 and HAO1-1379, each of which were synthesized with passenger (sense) strand modification pattern "SM107" and guide (antisense) strand modification pattern "M48" (patterns described above). To perform the study, a primary hyperoxaluria model was generated through oral gavage of 0.25 mL of 0.5 M glycolate to cause urine oxalate accumulation in C57BL/6 female mice. Animals were randomized and assigned to groups based on body weight. Intravenous dosing of animals with lipid nanoparticles (LNPs; here, an LNP formulation named EnCore-2345 was employed) containing 1 mg/kg or 0.1 mg/kg of DsiRNA was initiated on day 0. Dosing continued BIW for a total of three doses in mice prior to glycolate challenge. Four hour and 24 h urine samples were collected after glycolate challenge for assessment of oxalate/creatinine levels (see FIG. 4 for experimental flow chart). Animals were then sacrificed at 24 hrs after glycolate challenge. Liver was dissected and weighed, and HAO1 levels were assessed using RT-qPCR, ViewRNA, western blot for glycolate oxidase and/or glycolate oxidase immunohistochemistry (ViewRNA, western blot for glycolate oxidase and glycolate oxidase immunohistochemistry data not shown). Serum samples were also subjected to ELISA for detection of glycolate oxidase (data not shown). Notably, all eight DsiRNAs showed robust knockdown of HAO1 when administered at 1 mg/kg (FIG. 5). At least two (HAO1-1171 and HAO1-1378) of the eight DsiRNAs tested in vivo also showed robust knockdown of HAO1 in all treated animals when administered at 0.1 mg/kg. As shown in FIG. 5, administration of the HAO1-1171-M107/M48 DsiRNA at 0.1 mg/kg caused an average knockdown of 70% in liver tissue of treated mice, while administration at 1 mg/kg produced an average knockdown of 97% in liver tissue of treated mice. Similarly, administration of the HAO1-1378-M107/M48 DsiRNA at 0.1 mg/kg caused an average knockdown of 53% in liver tissue of treated mice, while administration at 1 mg/kg produced an average knockdown of 97% in liver tissue of treated mice. HAO-1171-induced knockdown at both 0.1 mg/kg and 1 mg/kg was further confirmed by ViewRNA in situ hybridization assays.

Figure 6:
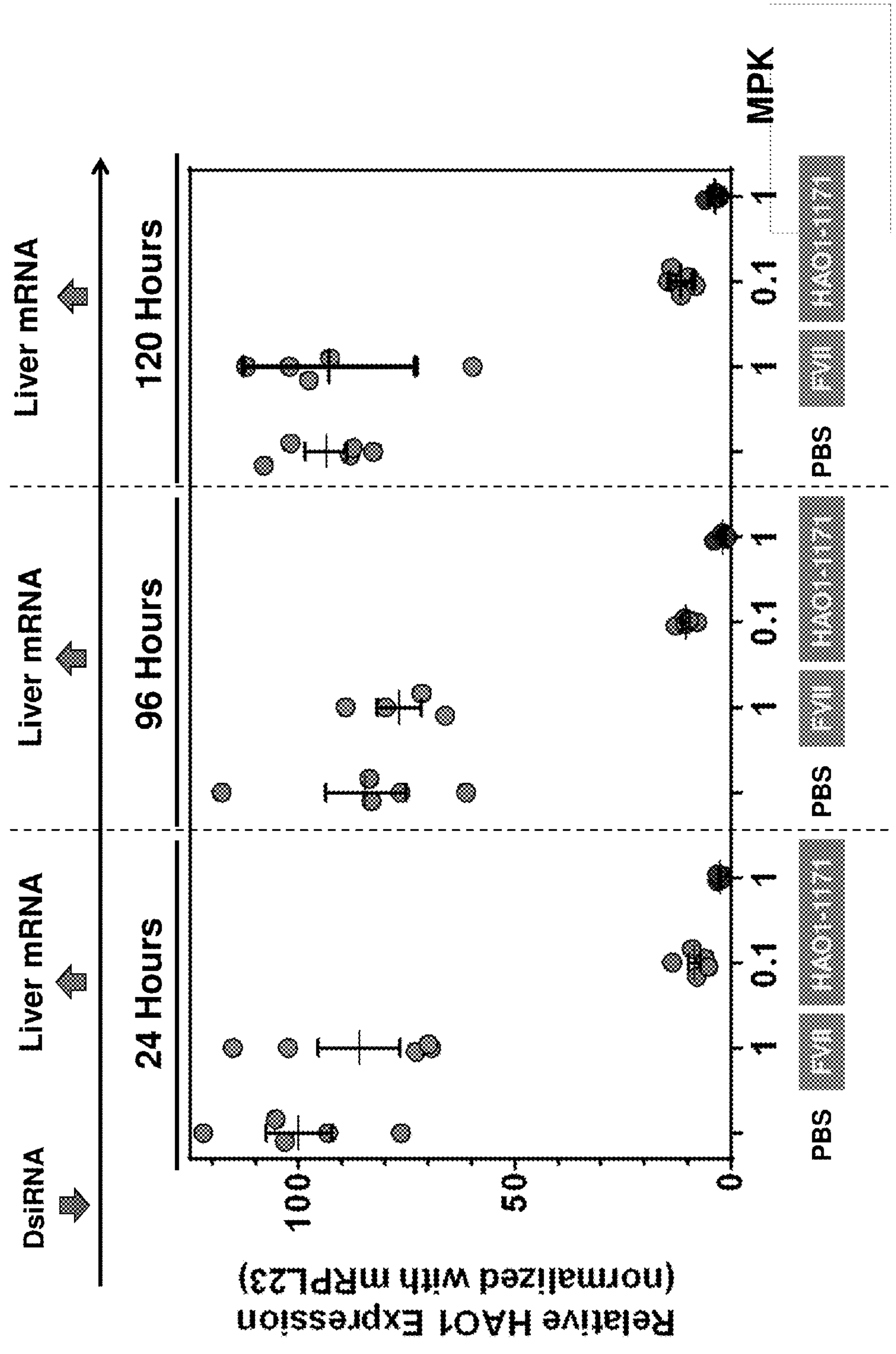
FIG. 6 shows that robust levels of HAO1 mRNA knockdown were observed in liver tissue of mice treated with 1 mg/kg and even 0.1 mg/kg amounts of HAO1-targeting DsiRNA HAO1-1171, with robust duration of efficacies observed (90% or greater levels of knockdown were observed at 120 hours post-administration for both 1 mg/kg and 0.1 mg/kg animals).

Robust levels of HAO1 mRNA knockdown were observed in liver tissue of mice treated with 1 mg/kg amounts of HAO1-targeting DsiRNAs HAO1-1171 and HAO1-1378 (FIG. 6 and data not shown), and even 0.1 mg/kg amounts of these HAO1-targeting DsiRNAs produced robust HAO1 knockdown. As shown in FIG. 6, single dose HAO1-1171 DsiRNA treatment achieved durable HAO1 mRNA target knockdown for at least 120 hours post-administration in the liver of treated animals. While robust HAO1 knockdown was achieved in liver, initial glycolate challenge experiments yielded inconclusive phenotypic results (data not shown).

In additional in vivo experiments, both HAO1 and oxalate levels were assessed in both control- and DsiRNA-treated genetically engineered PH1 model mice.

Figure 7A:
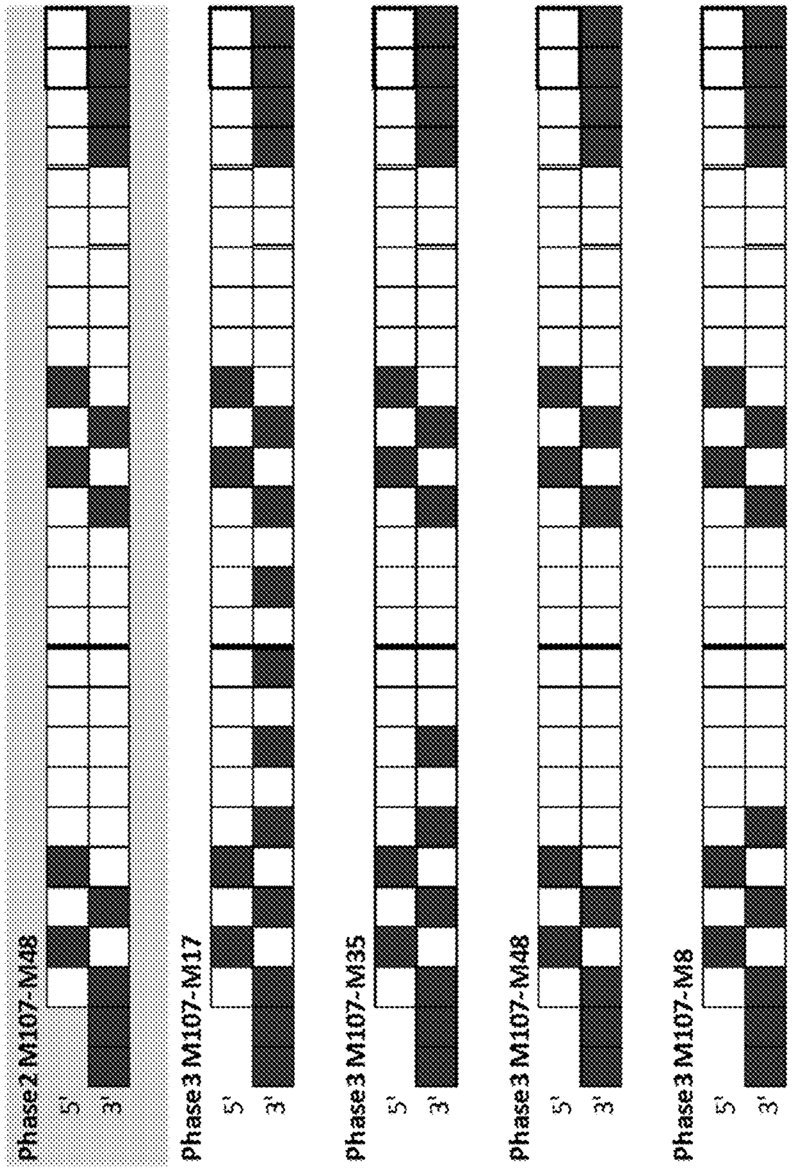
FIGS. 7A to 7E present modification pattern diagrams and histograms showing efficacy data for 24 independent HAO1-targeting DsiRNA sequences across four different guide (antisense) strand 2'-O-methyl modification patterns ("M17", "M35", "M48" and "M8", respectively, as shown in FIG. 7A and noting for FIGS. 7B to 7E that modification patterns are recited as passenger strand modification pattern (here, "M107")-guide strand modification pattern, e.g., "M107-M17", "M107-M35", "M107-M48" or "M107-M8") in human HeLa cells tested at 0.1 nM (duplicate assays) and 1 nM (FIGS. 7B and 7C) and mouse Hepa 1-6 cells for a subset of 8 duplexes tested at 0.03 nM, 0.1 nM (duplicate assays) and 1 nM (FIGS. 7D and 7E).
Figure 7B:
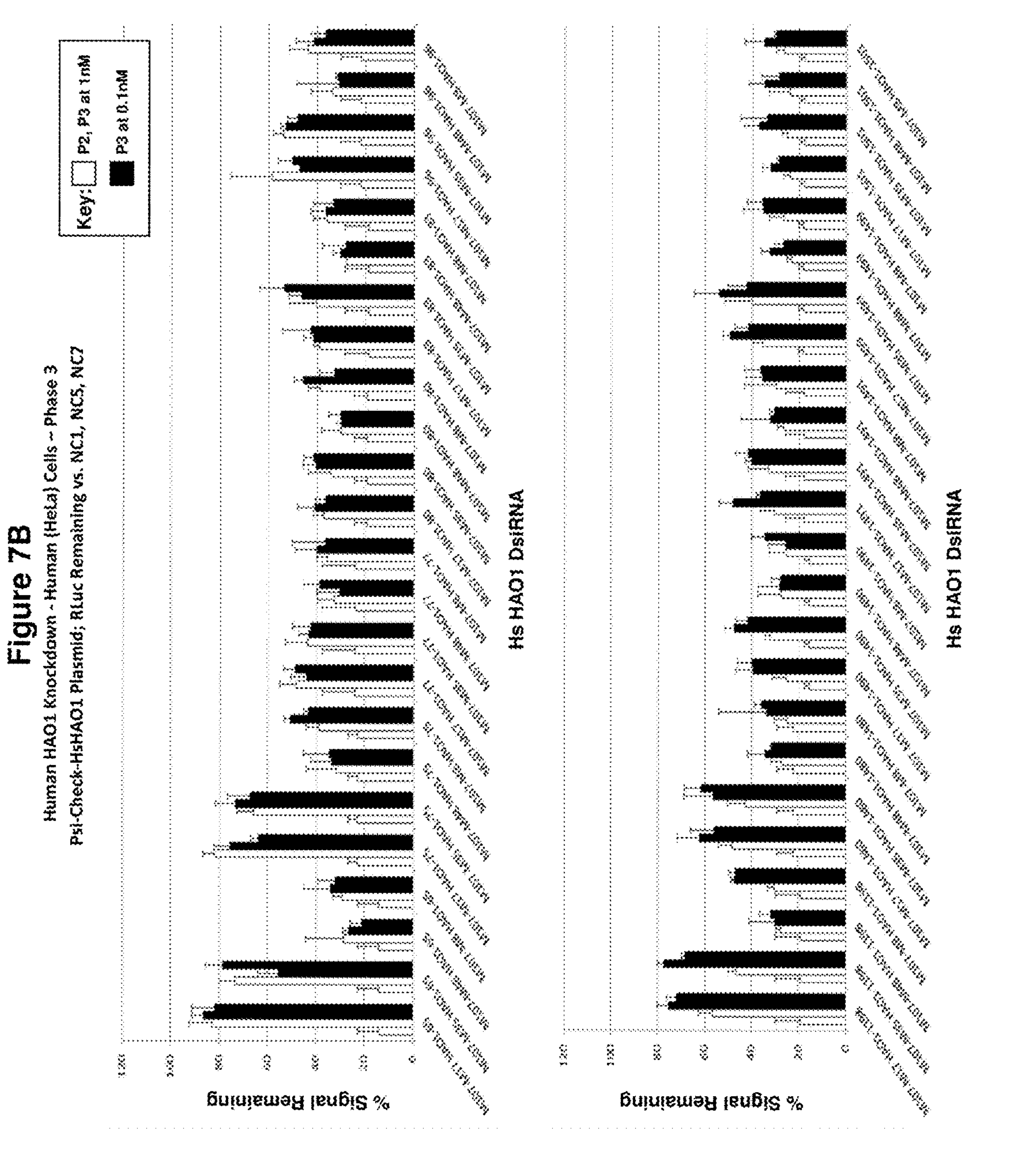
Figure 7C:
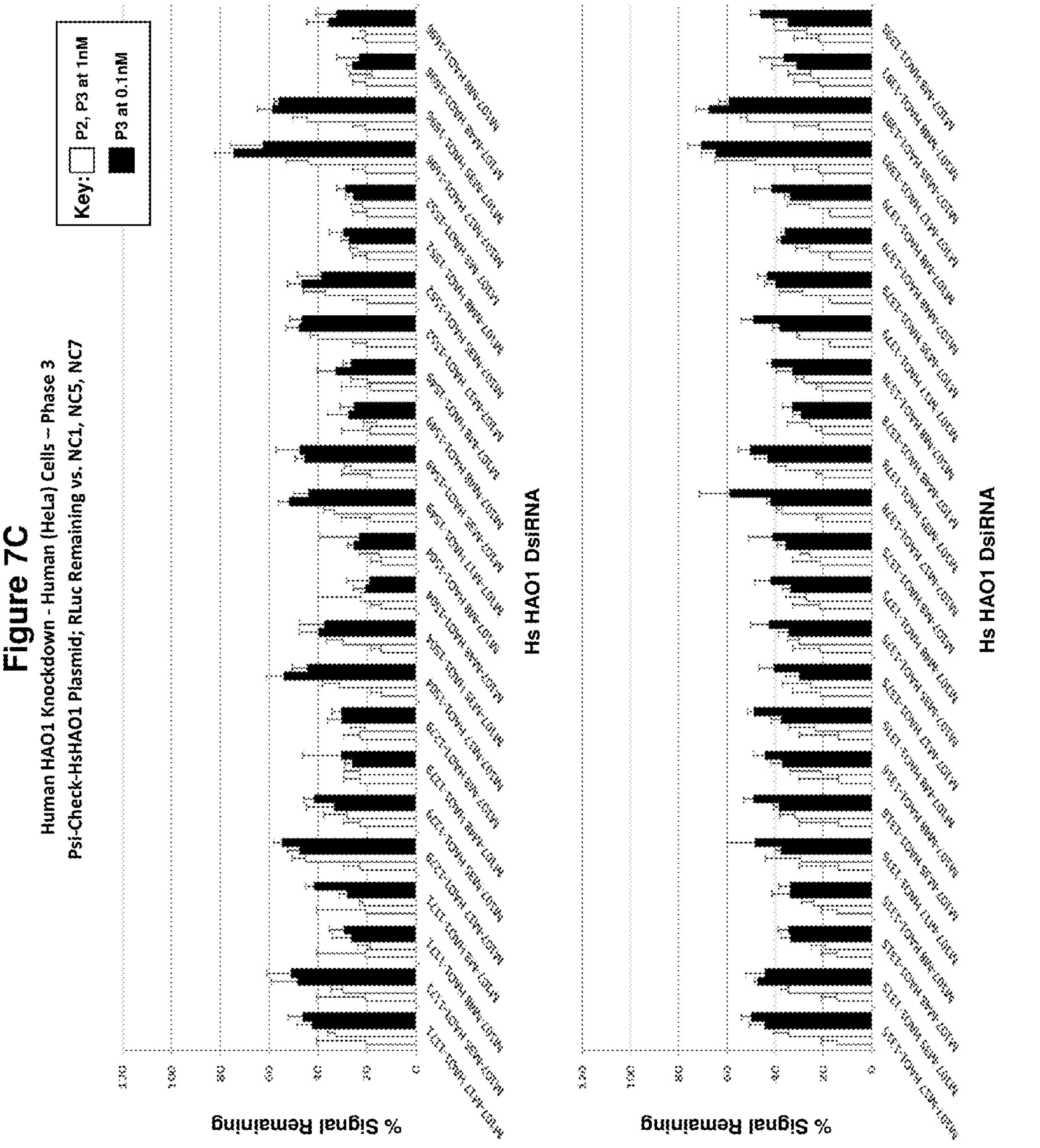

Example 5: Assessment of Modified Forms of Glycolate Oxidase-Targeting DsiRNAs In Vitro A selection of 24 DsiRNAs from Example 3 above were prepared with 2'-O-methyl guide strand modification patterns ("M17", "M35", "M48" and "M8" as shown above), paired with "M107" passenger strand modifications. For each of these DsiRNA sequences, DsiRNAs possessing each of the four guide strand modification patterns M17, M35, M48 and M8 coupled with the "M107" passenger strand modification pattern were assayed for HAO1 inhibition in human HeLa cells at 1.0 nM and 0.1 nM (in duplicate) concentrations in the environment of the HeLa cells. FIG. 7A shows specific modification patterns for such duplexes (with shaded residues indicating those possessing 2'-O-Methyl modifications), while FIGS. 7B and 7C show human HAO1 knockdown efficacy data for each of the four modified duplexes associated with the 24 duplex sequences examined (HAO1-65, 75, 77, 80, 83, 96, 1198, 1480, 1490, 1491, 1499, 1501, 1171, 1279, 1504, 1549, 1552, 1696, 1315, 1316, 1375, 1378, 1379 and 1393). As demonstrated in FIGS. 7B and 7C, many tested duplexes were demonstrated to possess robust HAO1 knockdown efficacy at even 0.1 nM concentrations across the full range of highly modified forms tested.

Figure 7D:
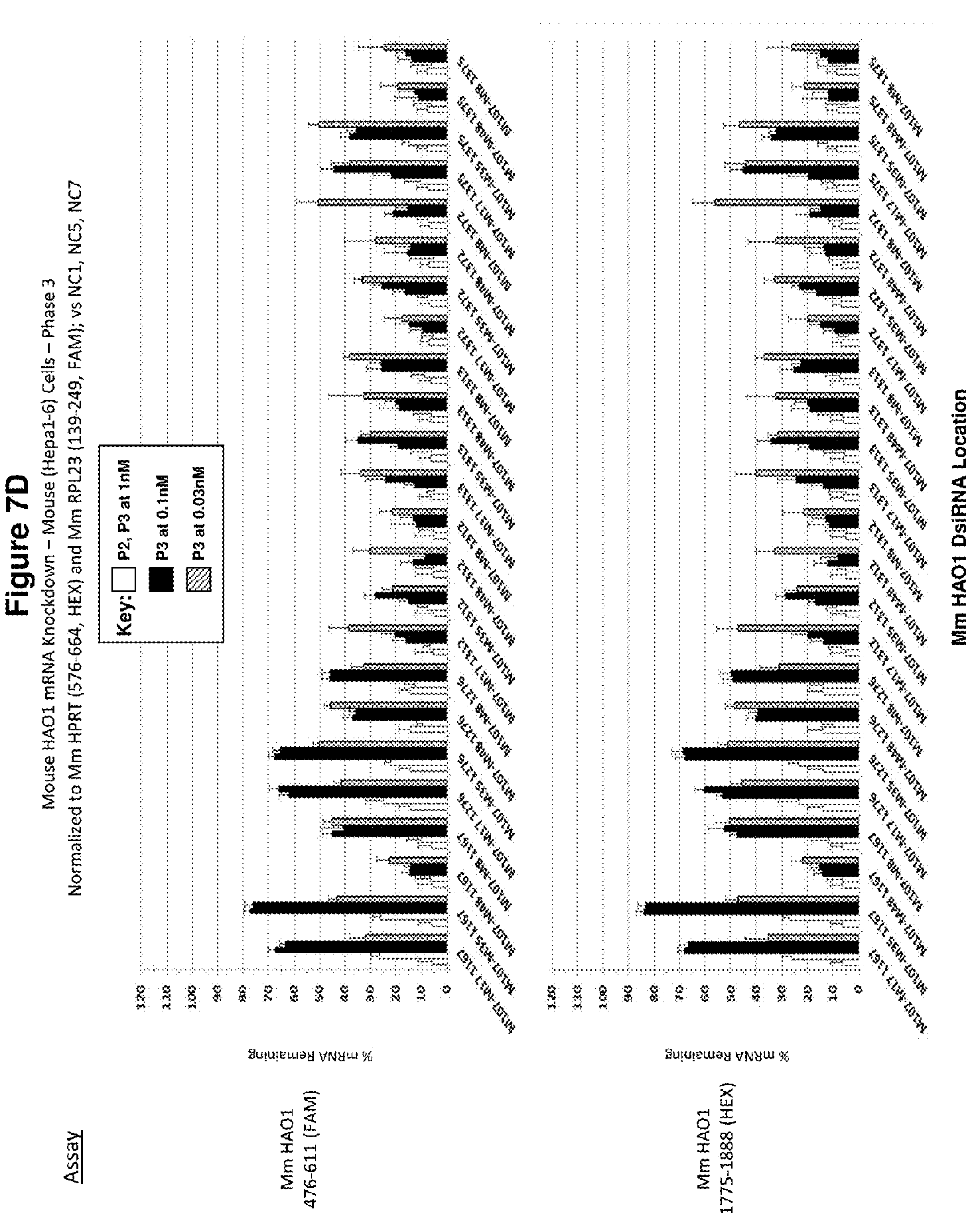
Figure 7E:
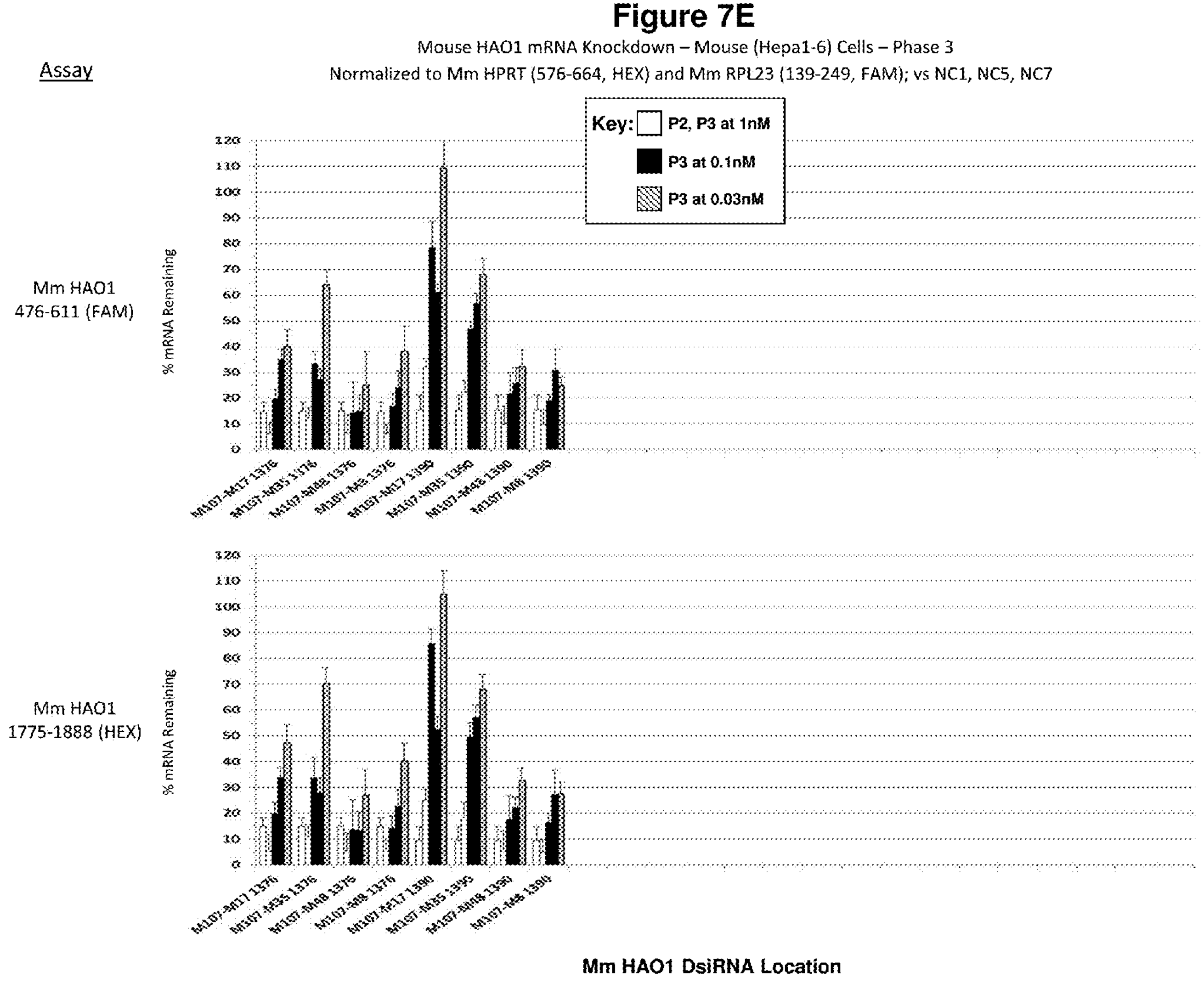

Eight duplex sequences (HAO1-m1167, m1276, m1312, m1313, m1372, m1375, m1376 and m1390, which correspond to human duplexes HAO1-1171, 1279, 1315, 1316, 1375, 1378, 1379 and 1393, respectively) were also examined for knockdown efficacy in mouse Hepal-6 cells across the same range of four duplex modification patterns. As shown in FIGS. 7D and 7E, a majority of these duplexes showed robust HAO1 knockdown efficacy in mouse cells across a range of duplex modification patterns, at concentrations as low as 0.03 nM.

Figure 8A:
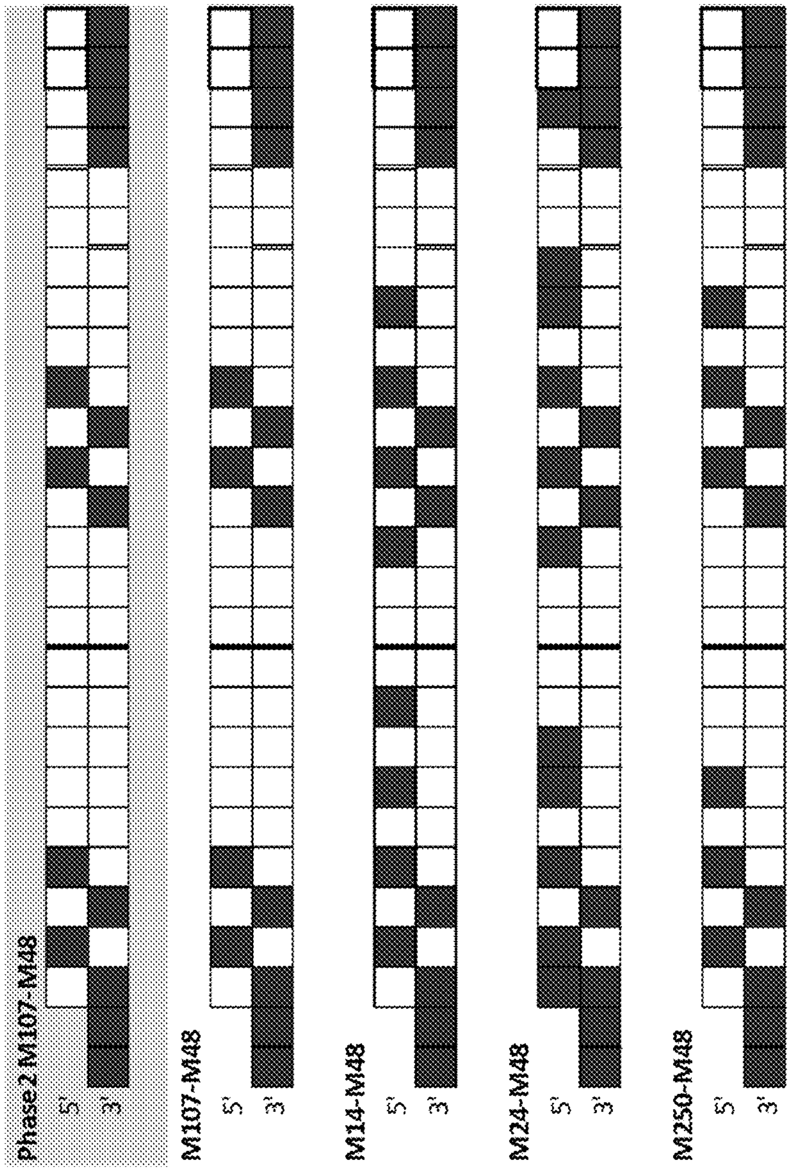
FIGS. 8A to 8E present modification pattern diagrams and histograms showing efficacy data for 24 independent HAO1-targeting DsiRNA sequences across four different passenger (sense) strand 2'-O-methyl modification patterns ("M107", "M14", "M24" and "M250", respectively, as shown in FIG. 8A and noting for FIGS. 8B to 8E that modification patterns are recited as passenger strand modification pattern-guide (here, "M48") strand modification pattern, e.g., "M107-M48", "M14-M48", "M24-M48" or "M250-M48") in human HeLa cells tested at 0.1 nM (duplicate assays) and 1 nM (FIGS. 8B and 8C) and mouse Hepa 1-6 cells for a subset of 8 duplexes tested at 0.03 nM, 0.1 nM (duplicate assays) and 1 nM (FIGS. 8D and 8E).
Figure 8B:
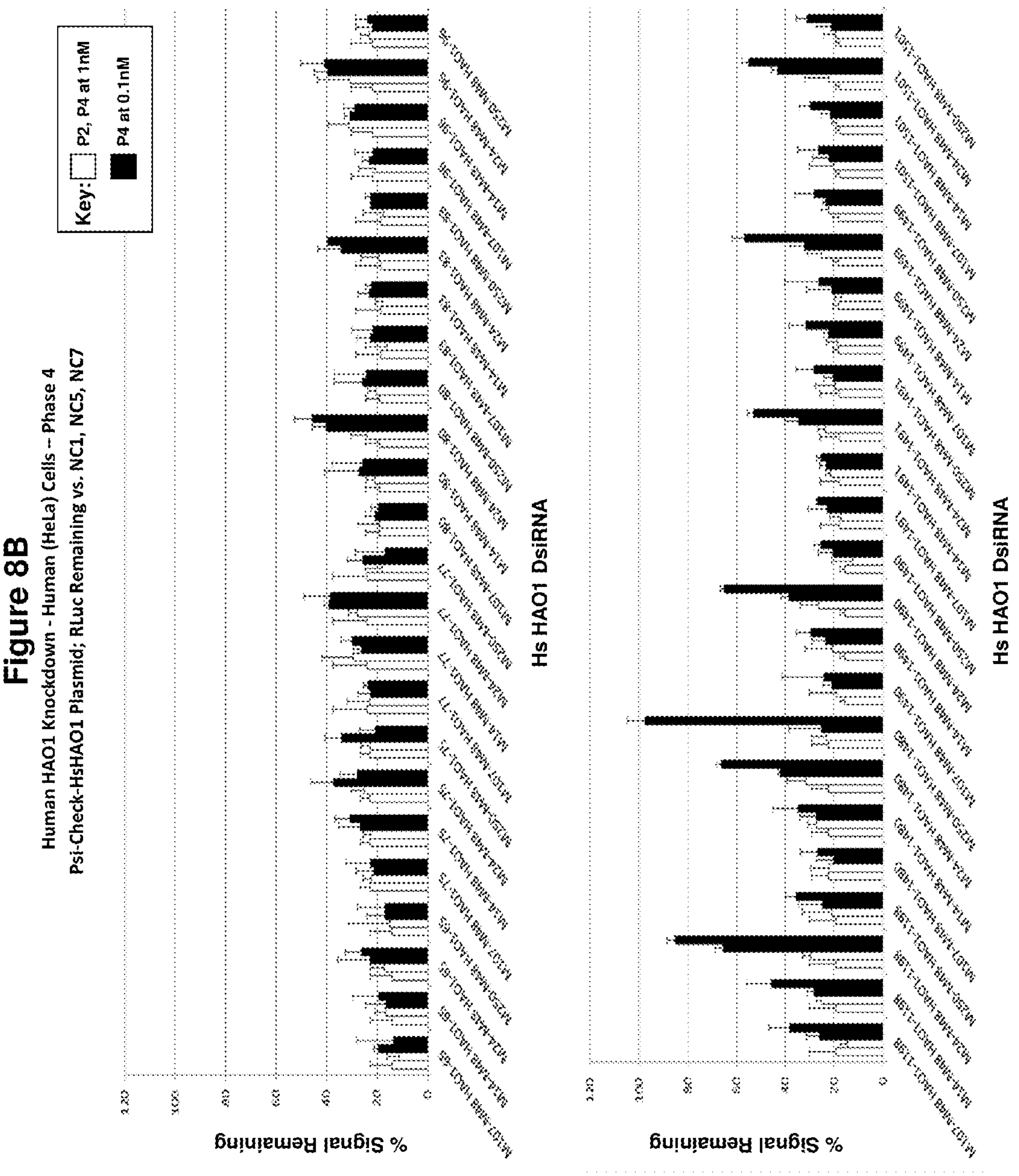
Figure 8C:
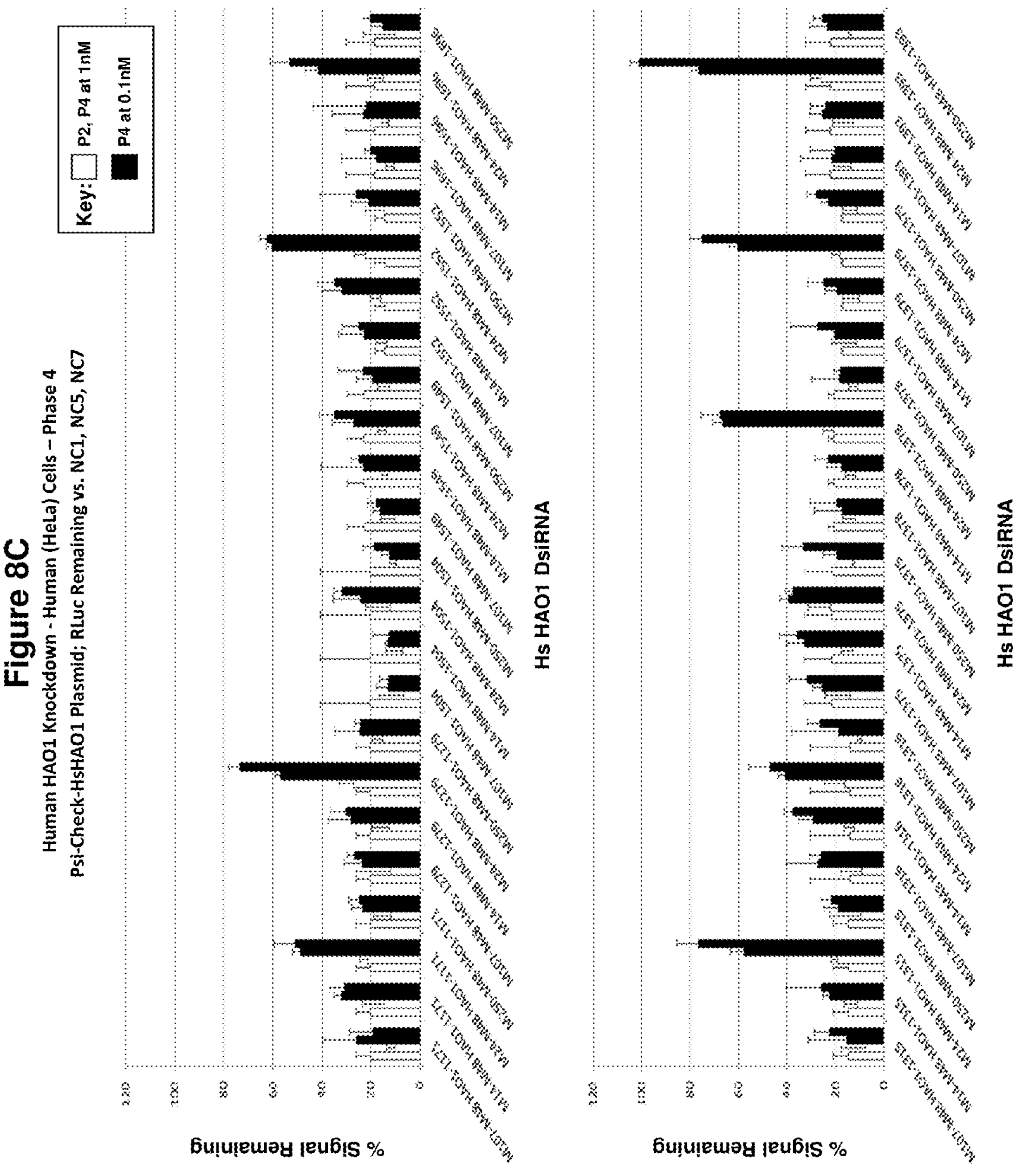

Example 6: Assessment of Additionally Modified Forms of Glycolate Oxidase-Targeting DsiRNAs In Vitro The same set of 24 HAO1-targeting duplex sequences as set forth above in Example 5 were prepared to possess a range of four 2'-O-methyl passenger strand modification patterns ("M107", "M14", "M24" and "M250") coupled with a fixed "M48" guide strand modification pattern. These DsiRNAs were assayed for HAO1 inhibition at 1.0 nM and 0.1 nM (in duplicate) concentrations in the environment of the HeLa cells. FIG. 8A shows specific modification patterns for such duplexes (with shaded residues indicating those possessing 2'-O-Methyl modifications), while FIGS. 8B and 8C show human HAO1 knockdown efficacy data for each of the four modified duplexes associated with the 24 duplex sequences examined (HAO1-65, 75, 77, 80, 83, 96, 1198, 1480, 1490, 1491, 1499, 1501, 1171, 1279, 1504, 1549, 1552, 1696, 1315, 1316, 1375, 1378, 1379 and 1393). As demonstrated in FIGS. 8B and 8C, many of the additional tested duplexes were demonstrated to possess robust HAO1 knockdown efficacy at even 0.1 nM concentrations across the full range of highly modified passenger strand (with fixed guide strand modification pattern) forms tested.

Figure 8D:
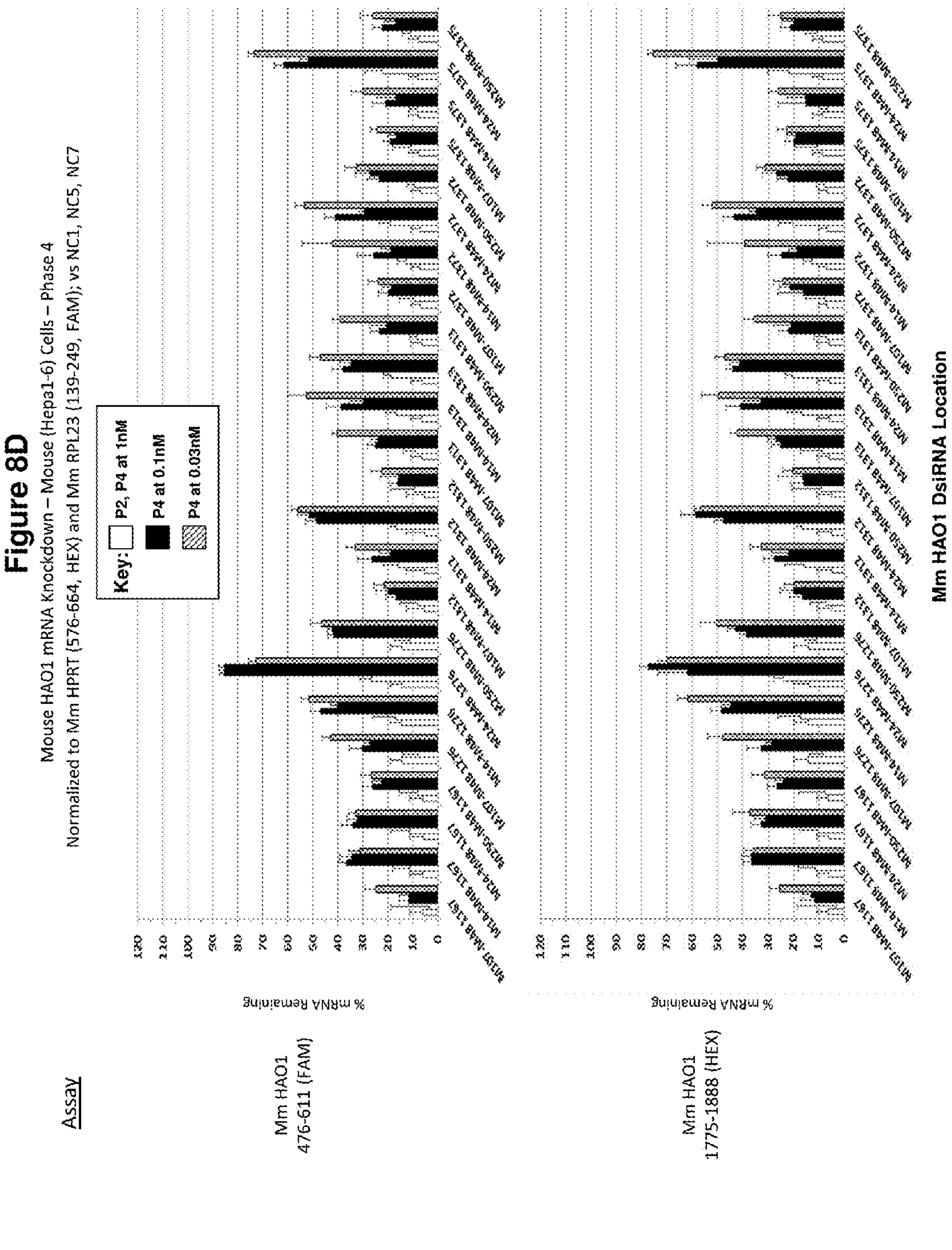
Figure 8E:
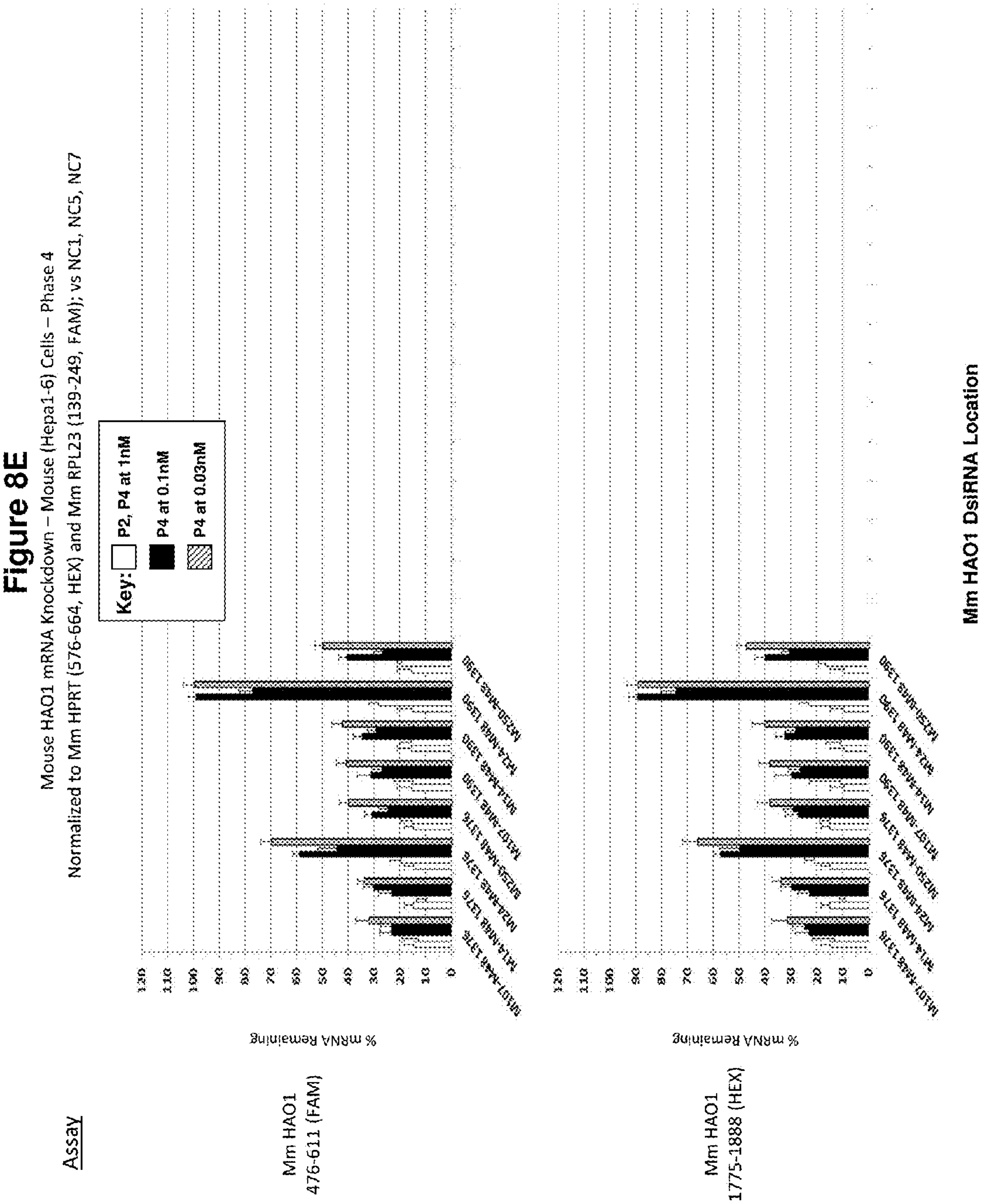
Figure 9A:
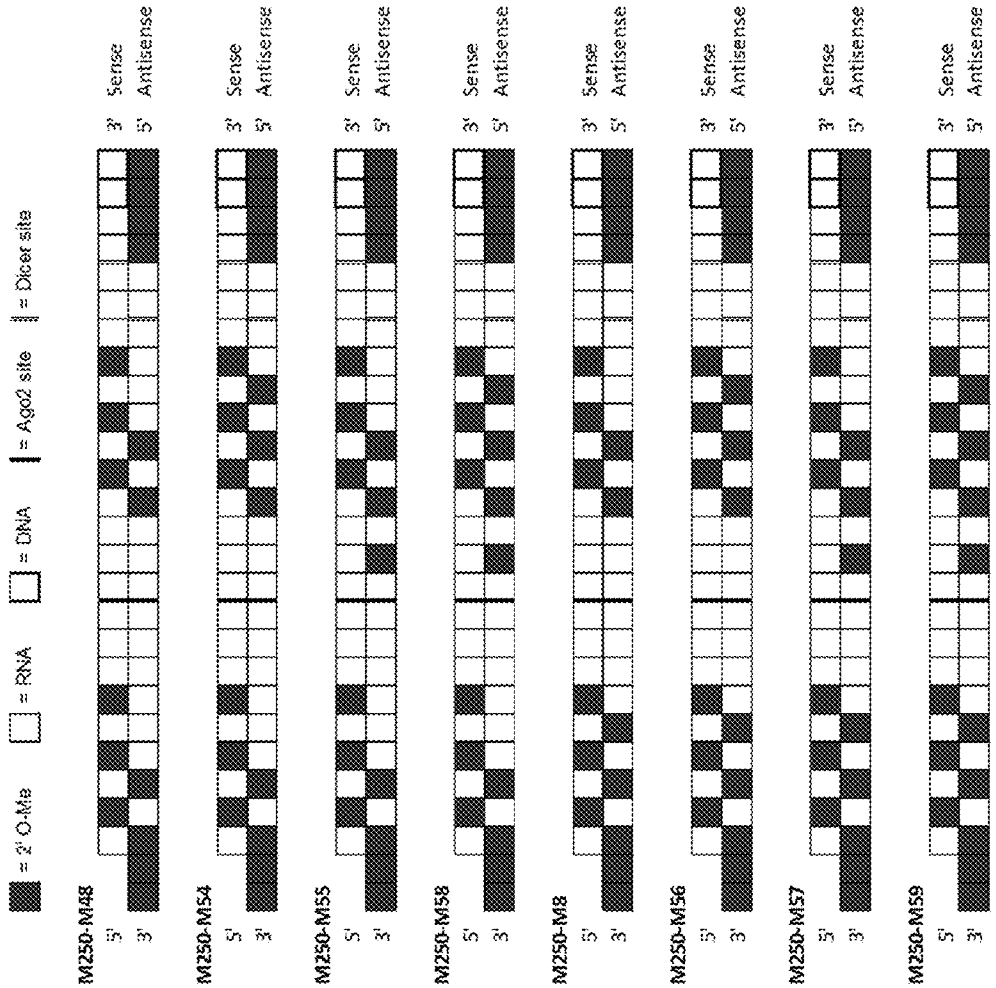
FIGS. 9A to 9L present modification pattern diagrams and histograms showing efficacy data for 24 independent HAO1-targeting DsiRNA sequences across indicated passenger (sense) and guide (antisense) strand 2'-O-methyl modification patterns (noting that modification patterns are recited as passenger strand modification pattern-guide strand modification pattern) in human HeLa cells (FIGS. 9E to 9H) or HEK293-pcDNA HAO1 Cells (FIGS. 9I to 9L), tested at 0.1 nM (duplicate assays) and 1 nM, employing either a Psi-Check-HsHAO1 plasmid reporter assay, monitoring for knockdown of *Renilla* luciferase production (FIGS. 9E to 9H), or HEK293 cells stably transfected with HAO1 (HEK293-pcDNA HAO1 Cells.
Figure 9B:
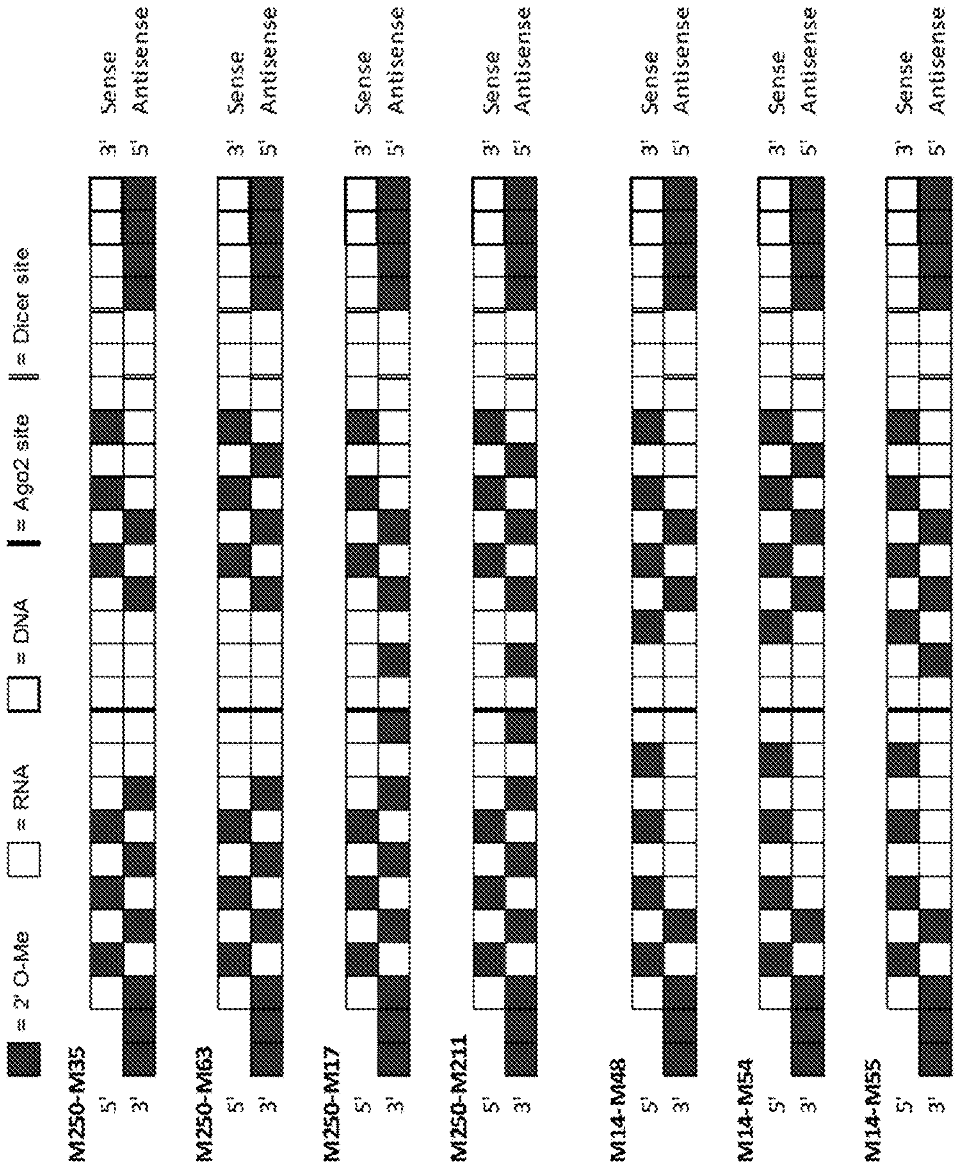
Figure 9C:
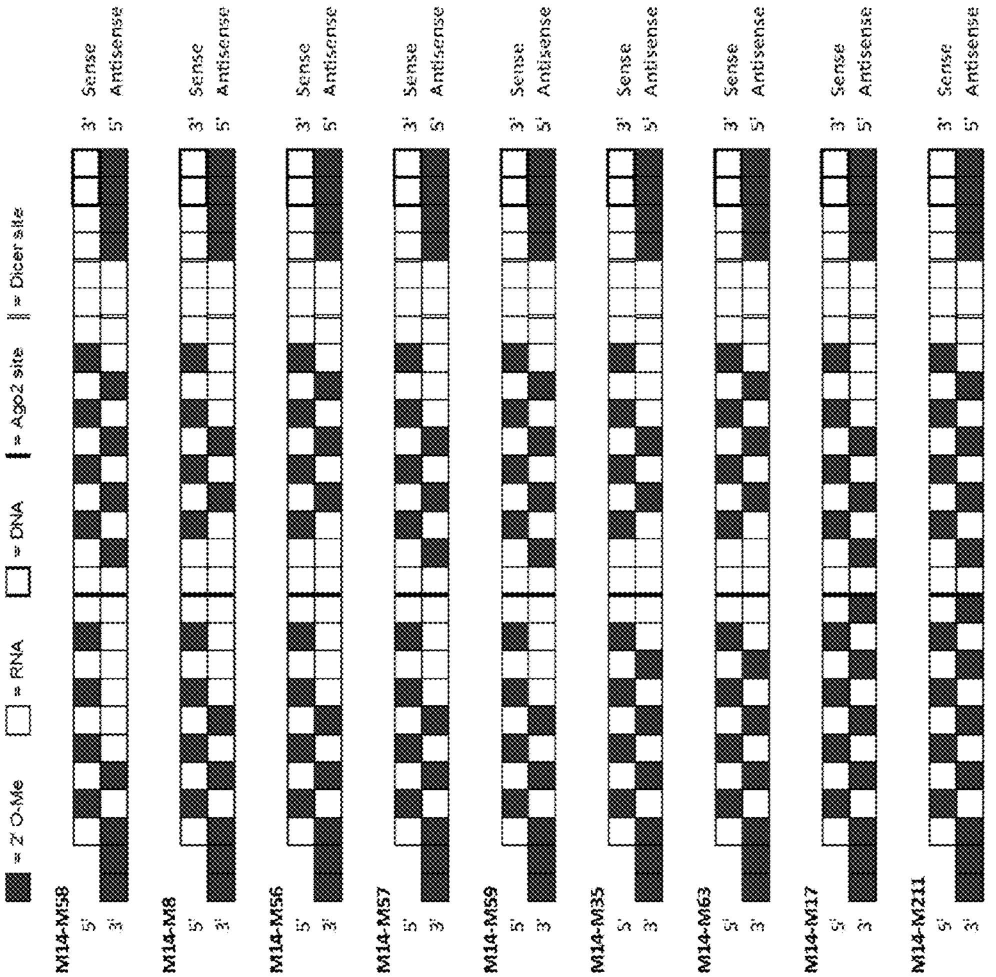
Figure 9D:
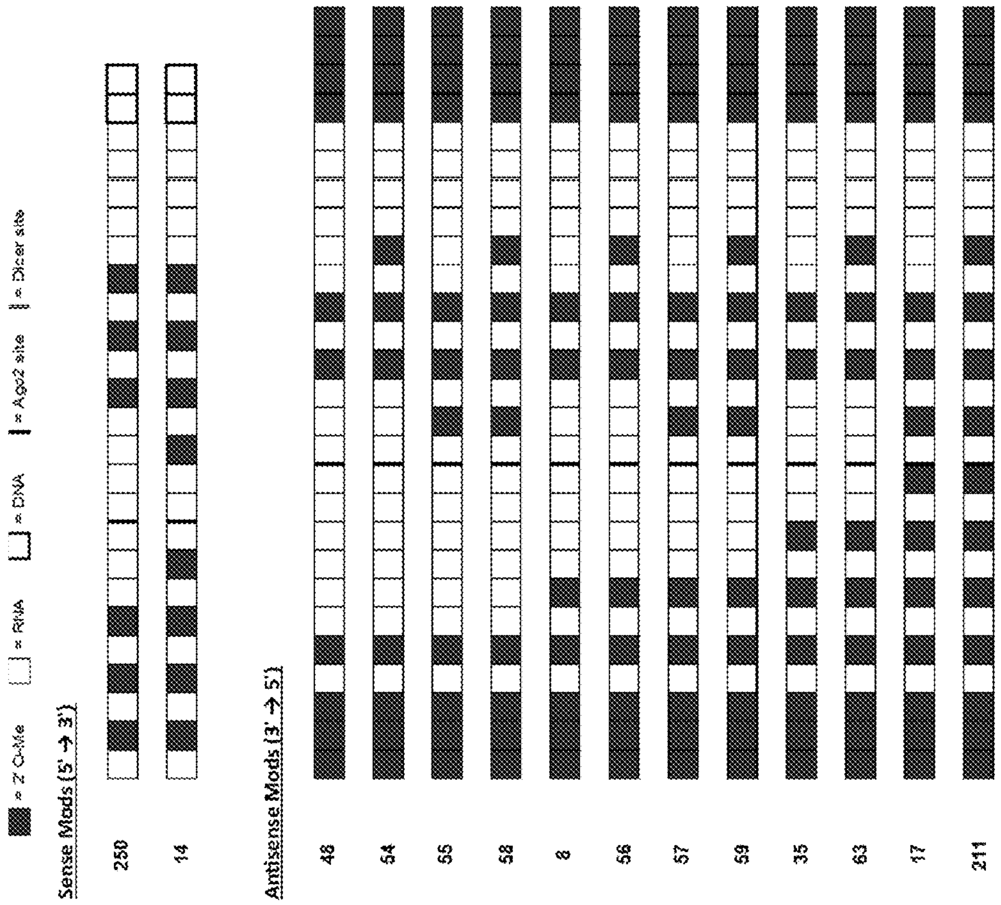
Figure 9E:
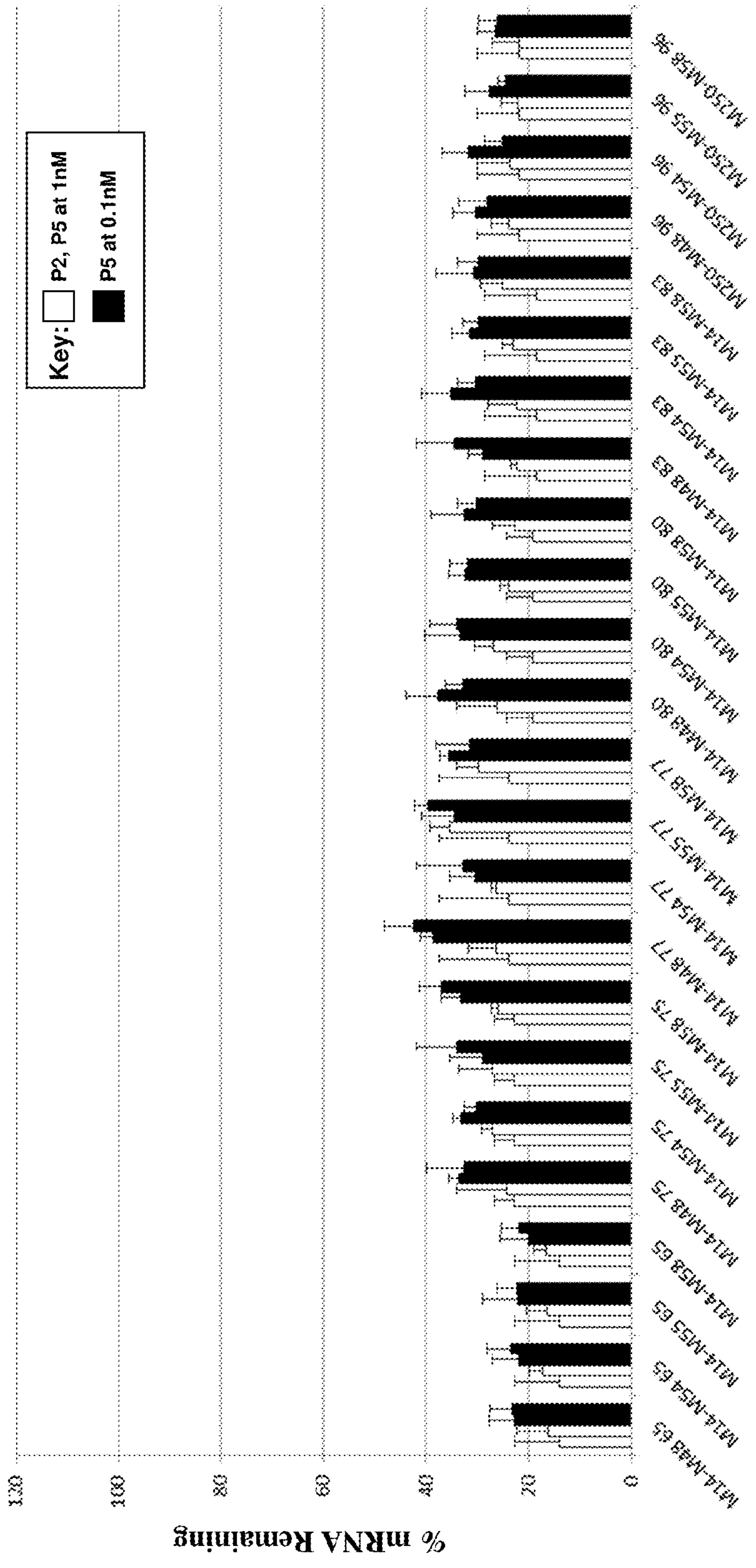
Figure 9F:
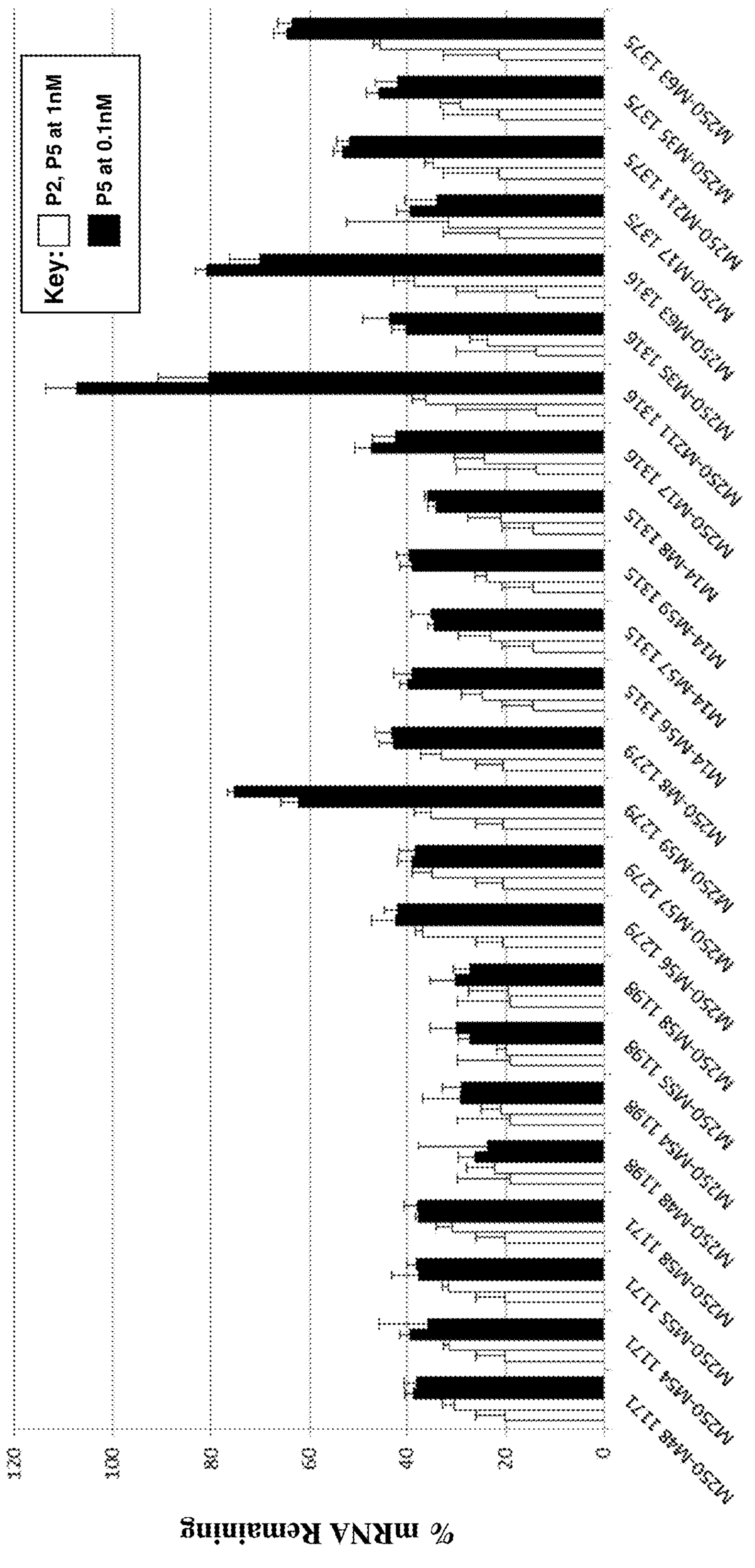
Figure 9G:
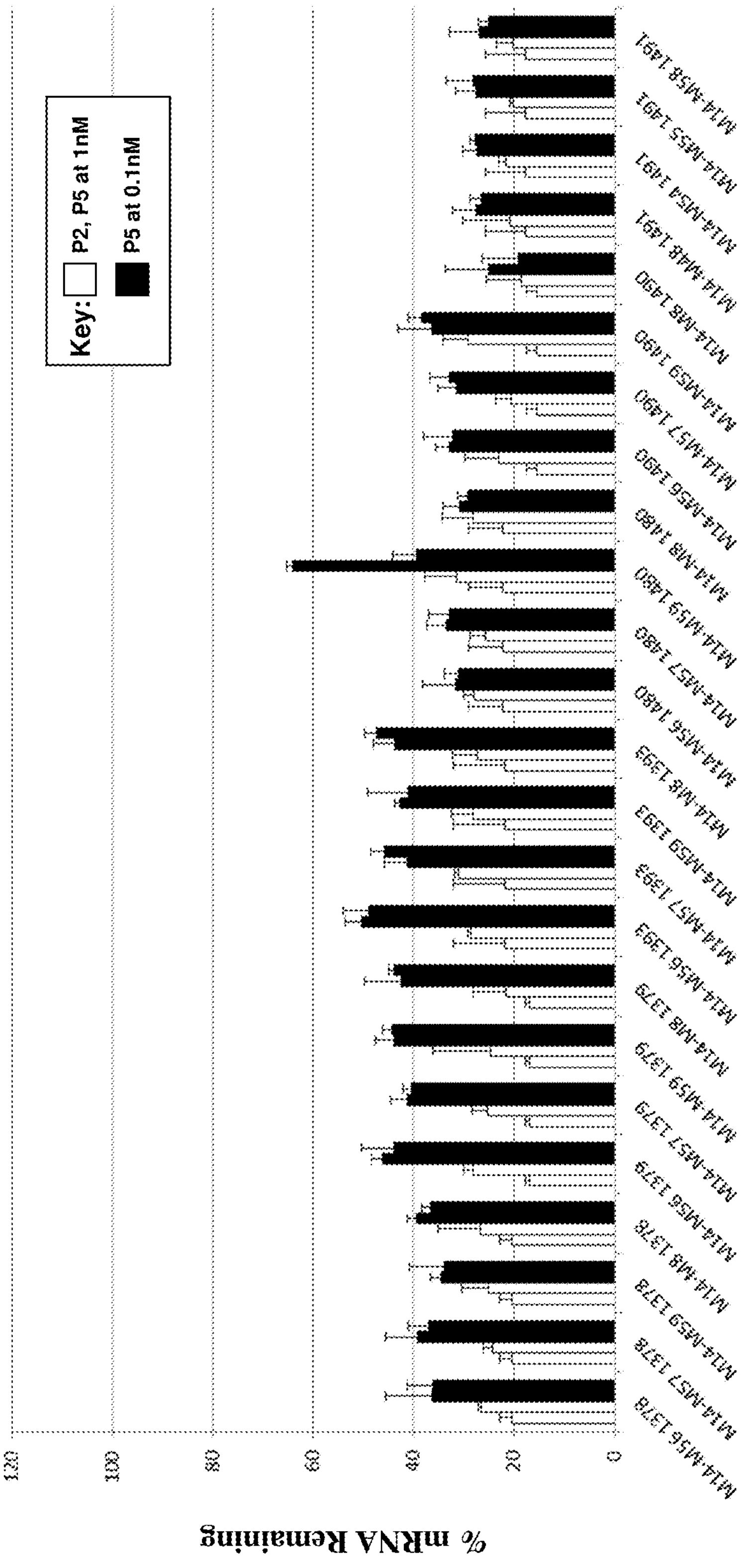
Figure 9H:
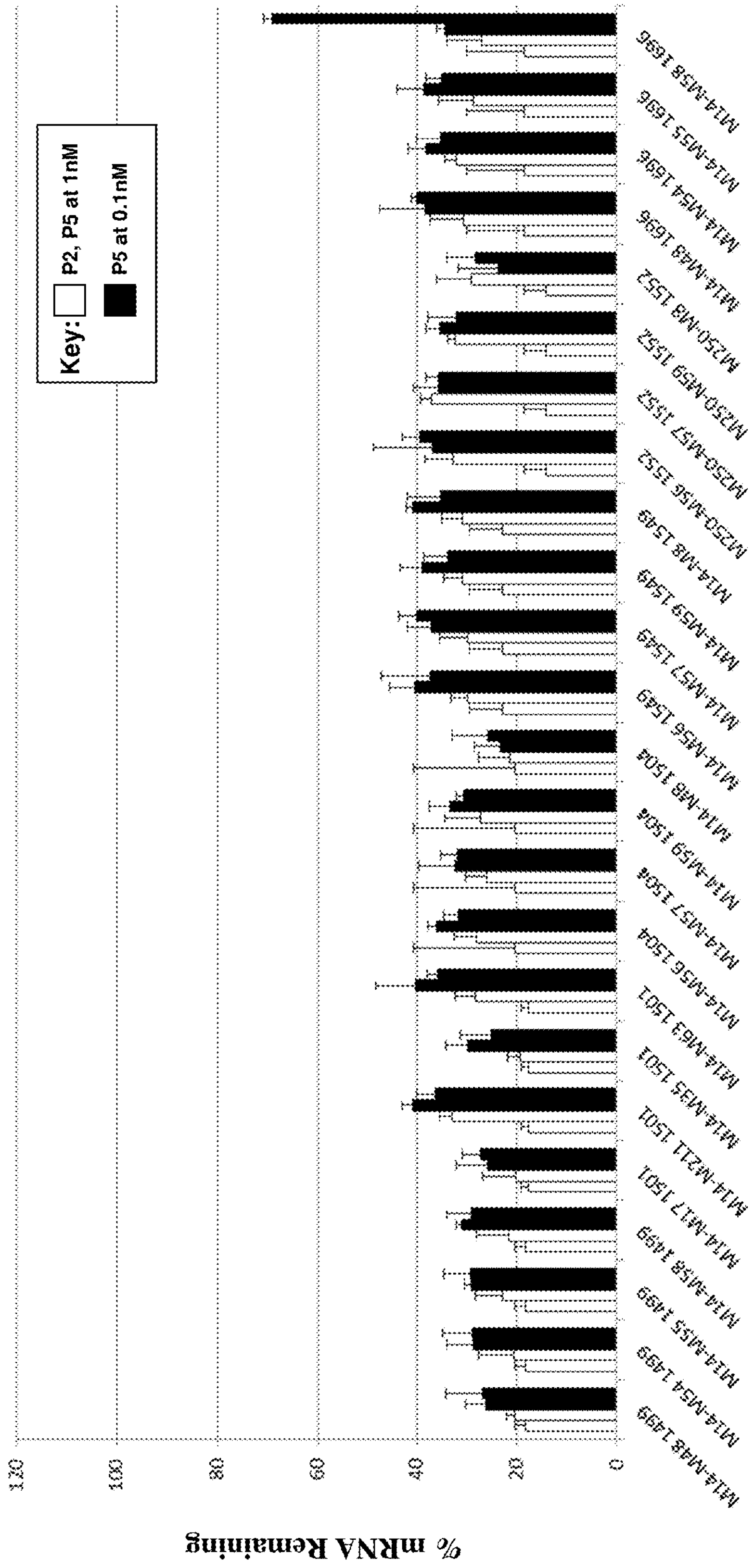
Figure 9I:
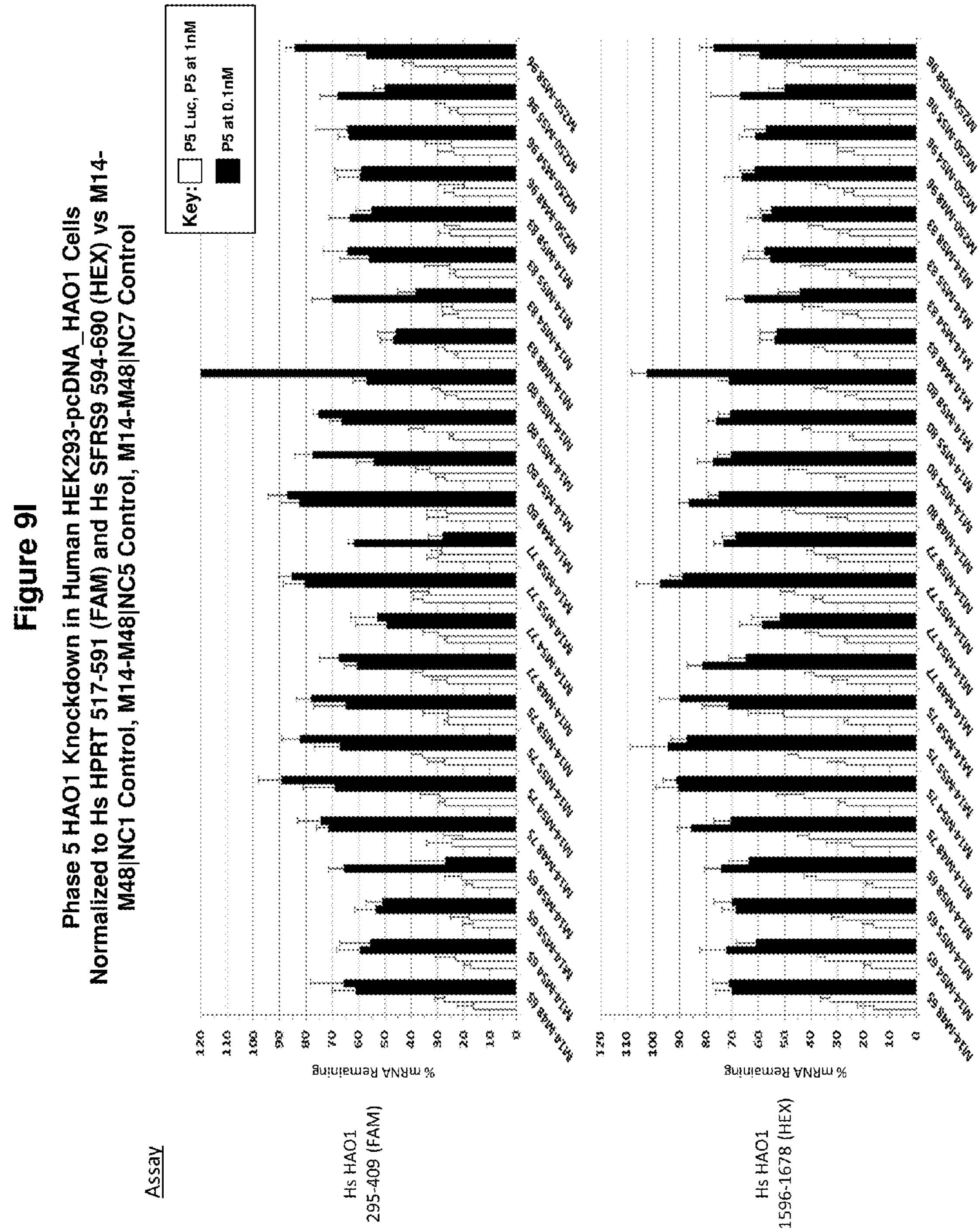
Figure 9J:
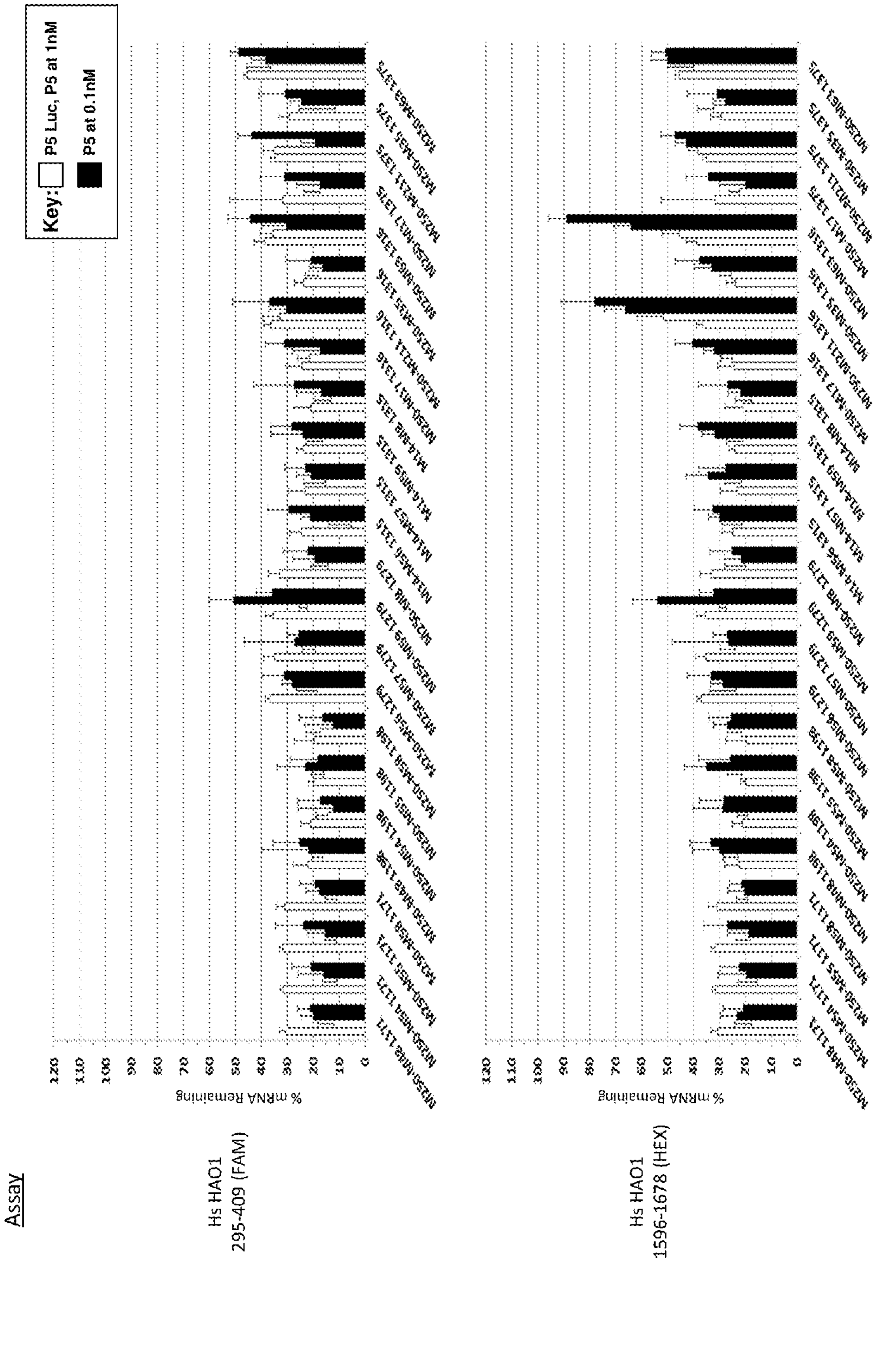
Figure 9K:
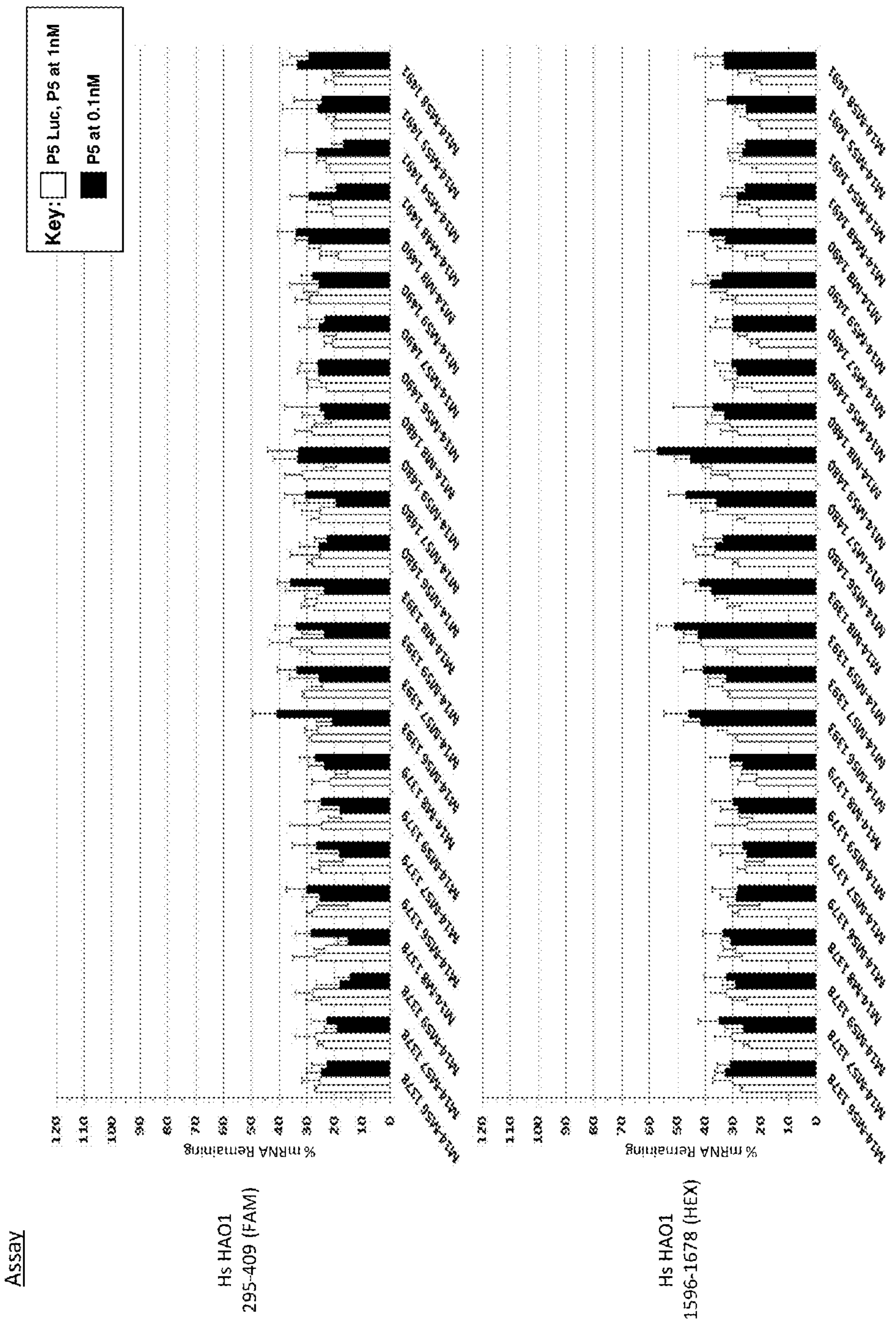
Figure 9L:
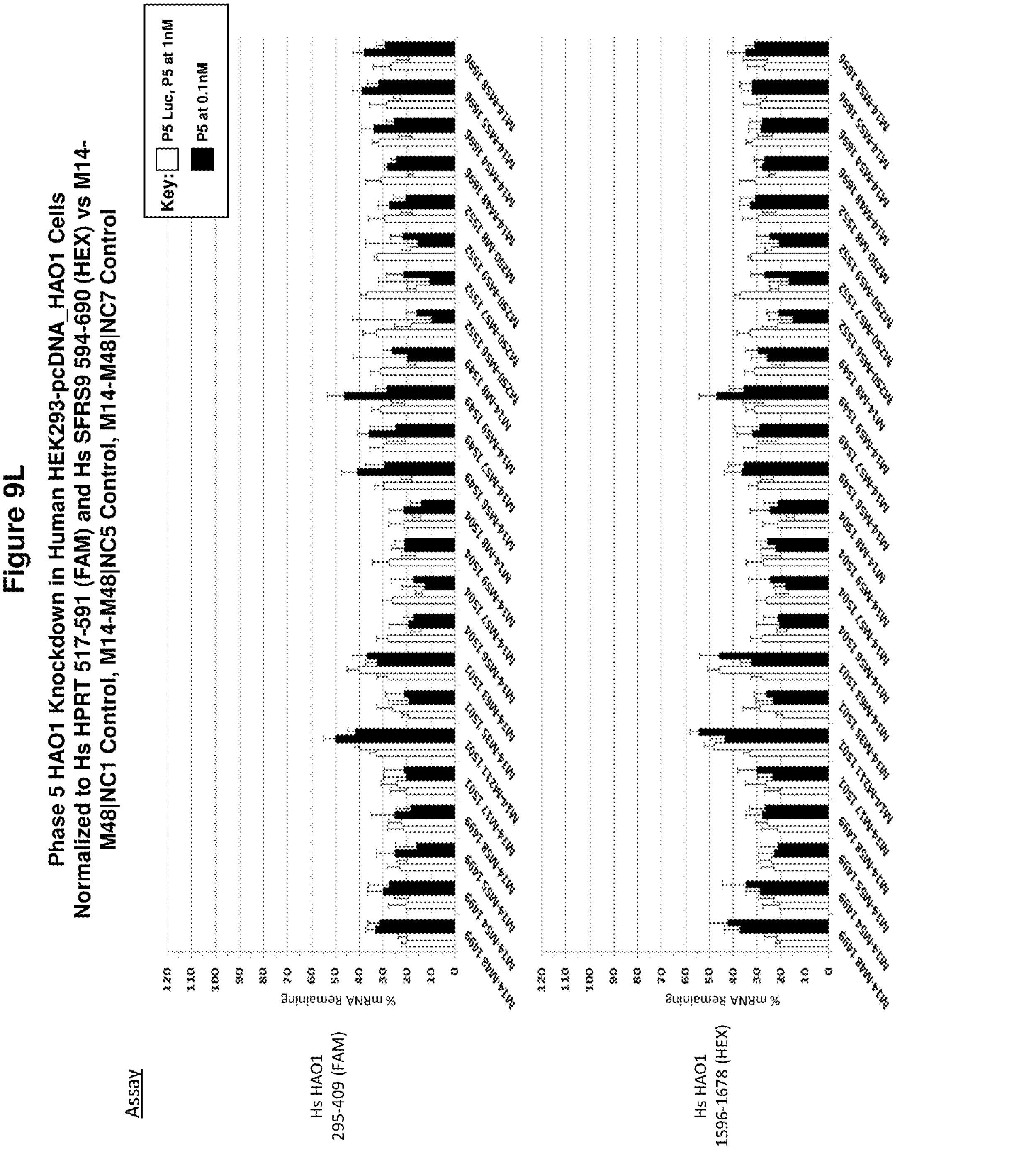
Figure 10A:
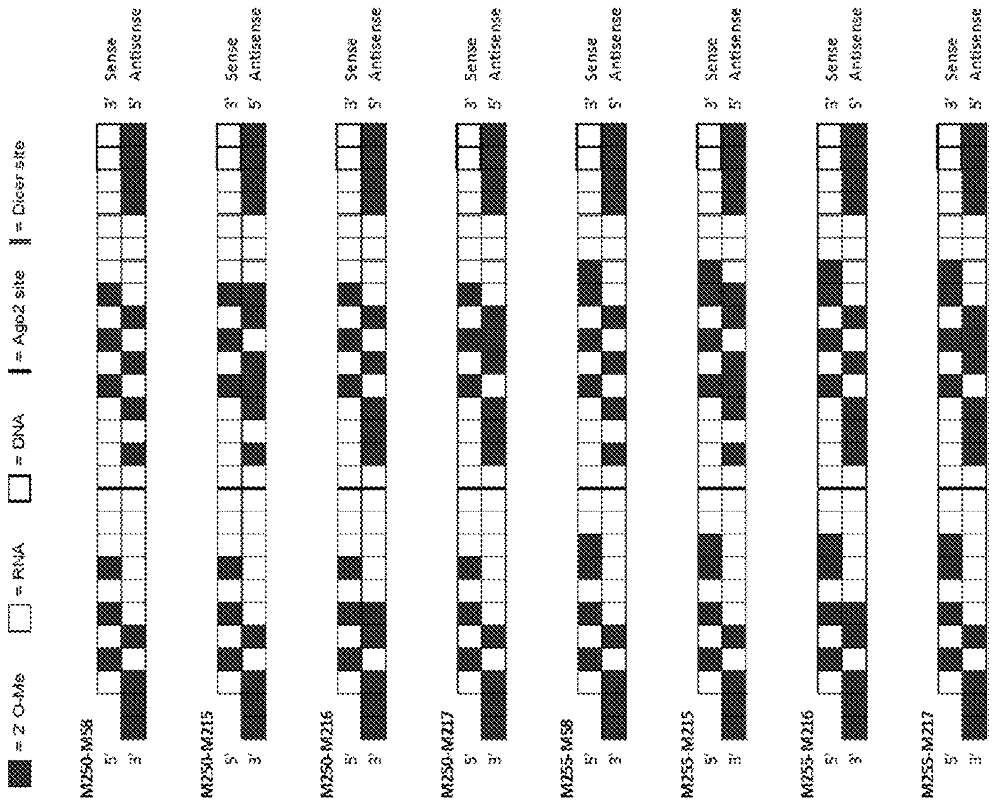
FIGS. 10A to 10O present modification pattern diagrams and histograms showing efficacy data for four independent HAO1-targeting DsiRNA sequences across indicated passenger (sense) and guide (antisense) strand 2'-O-methyl modification patterns (noting, as above, that modification patterns are recited as: passenger strand modification pattern-guide strand modification pattern) in HEK293 cells stably transfected with HAO1 (HEK293-pcDNA HAO1 Cells), assayed at 0.1 nM (duplicate assays) and 1 nM.
Figure 10B:
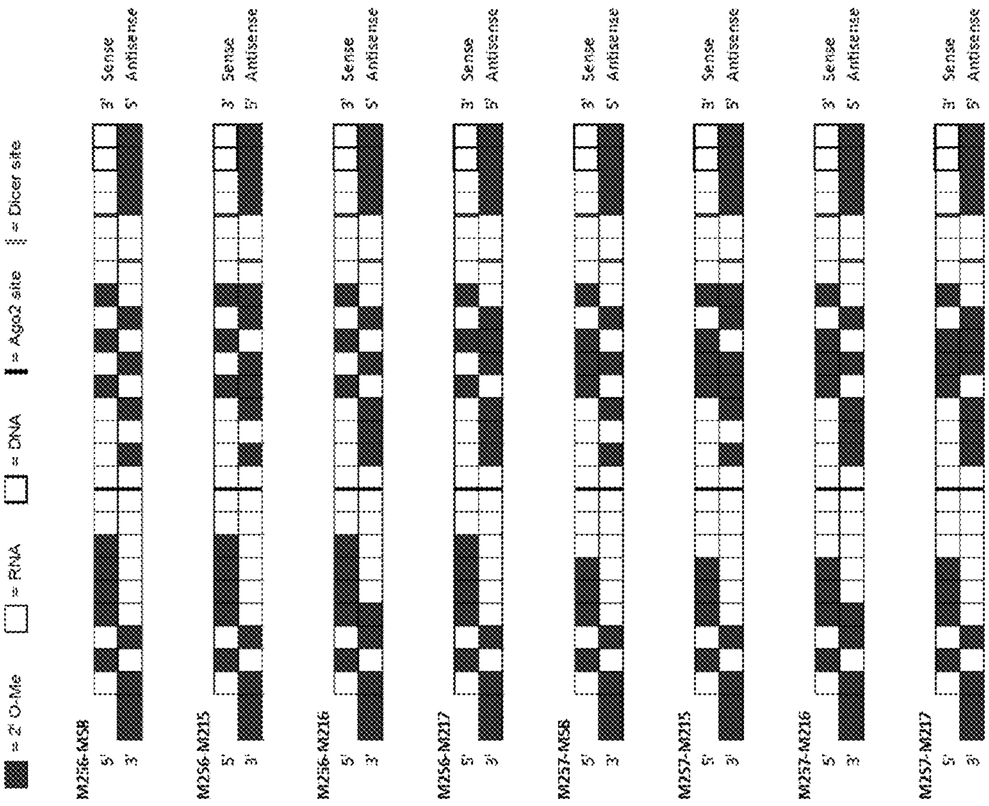
Figure 10C:
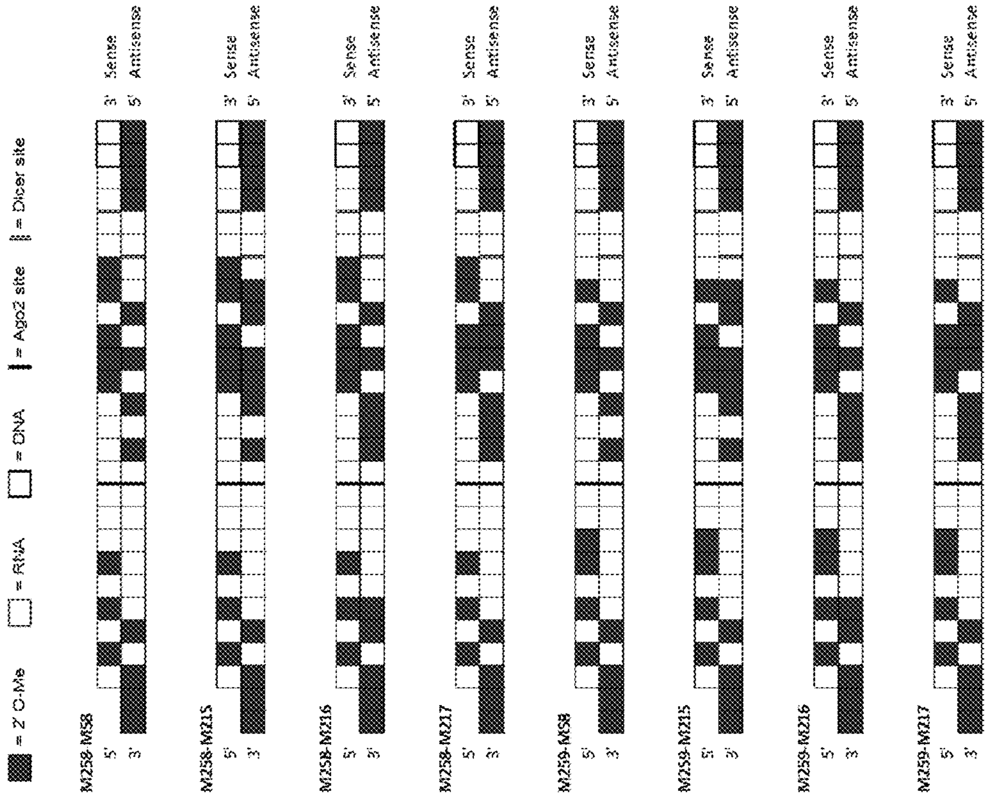
Figure 10D:
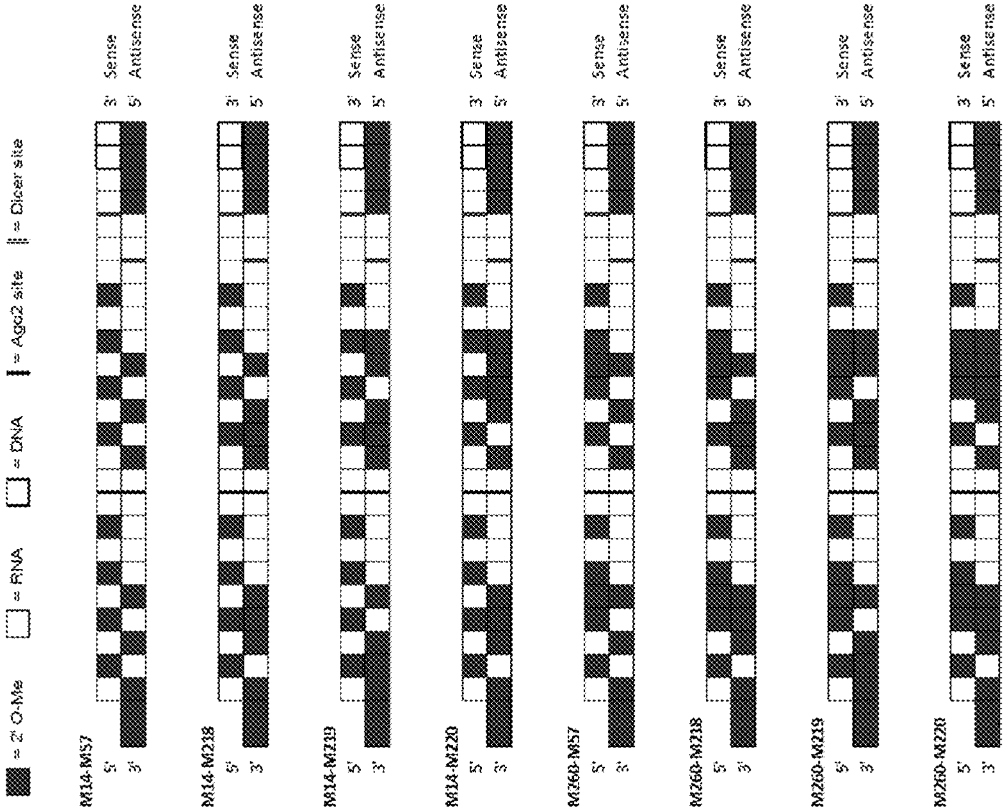
Figure 10E:
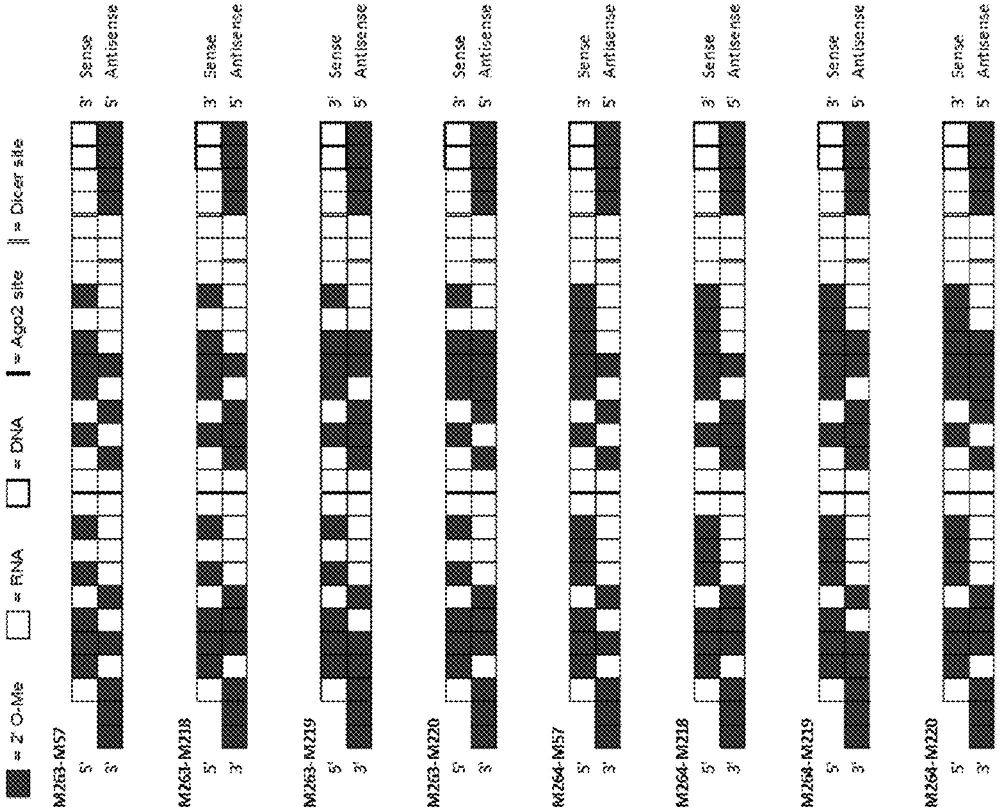
Figure 10F:
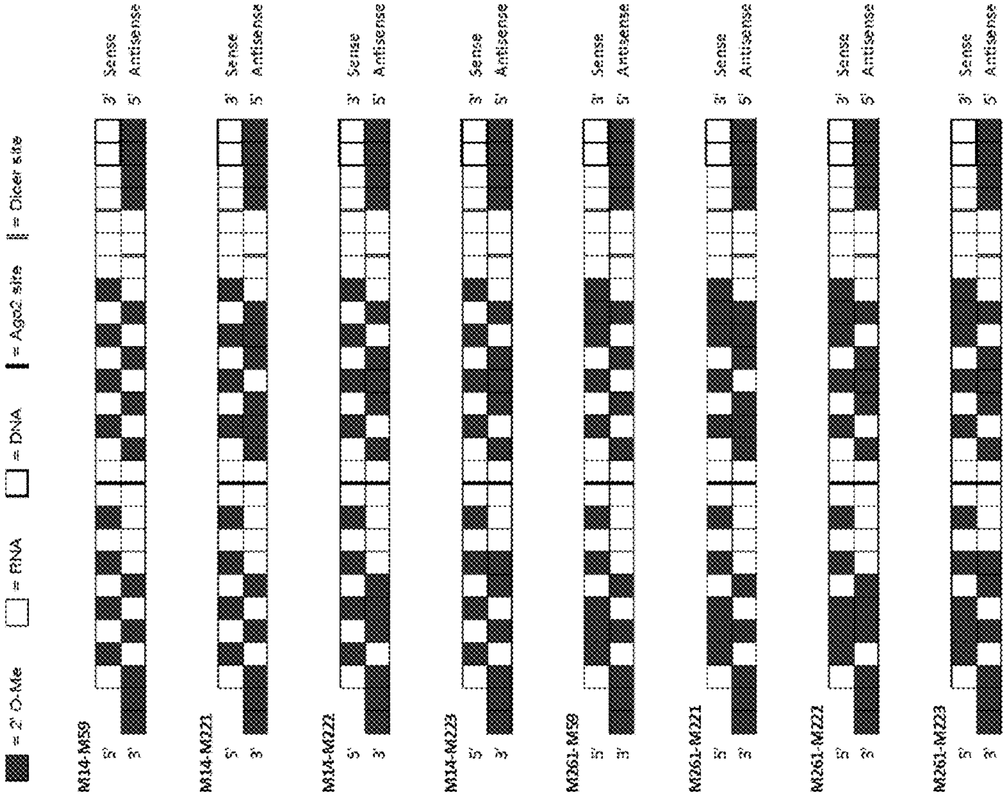
Figure 10G:
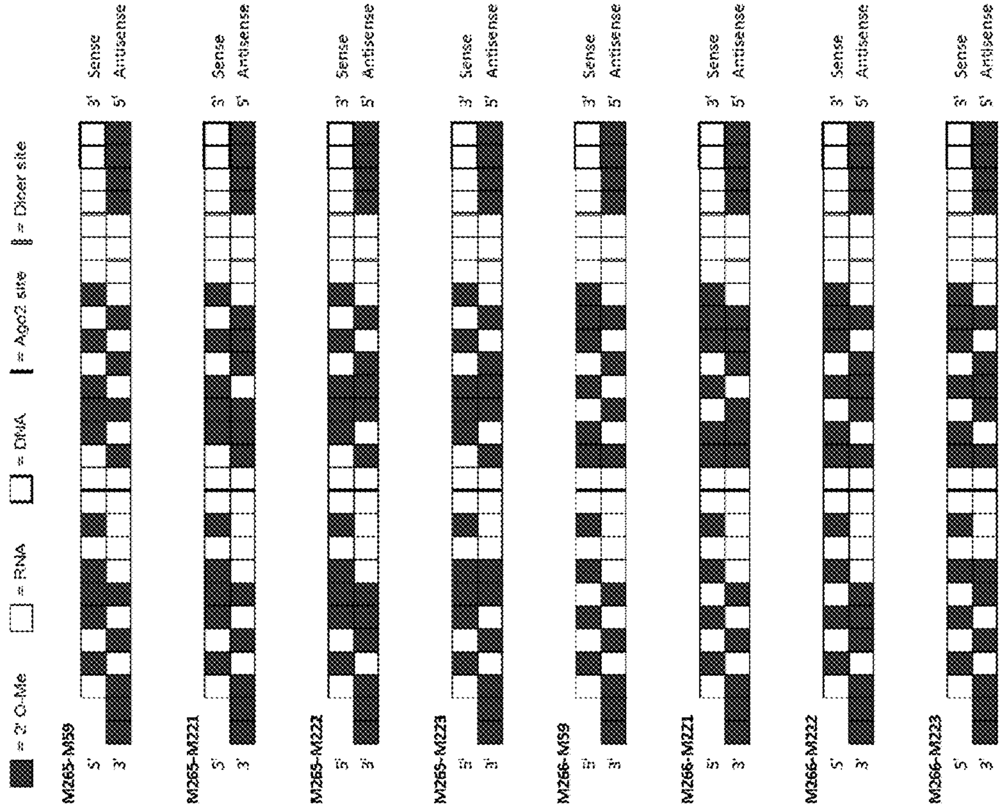
Figure 10H:
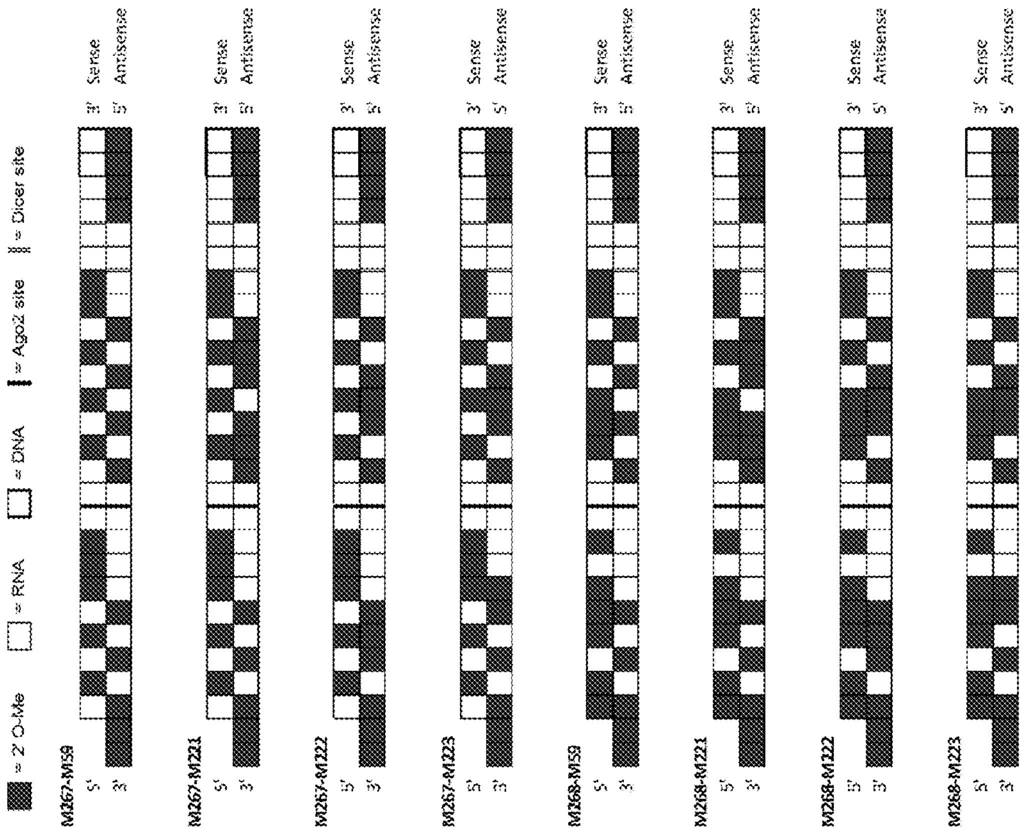
Figure 10I:
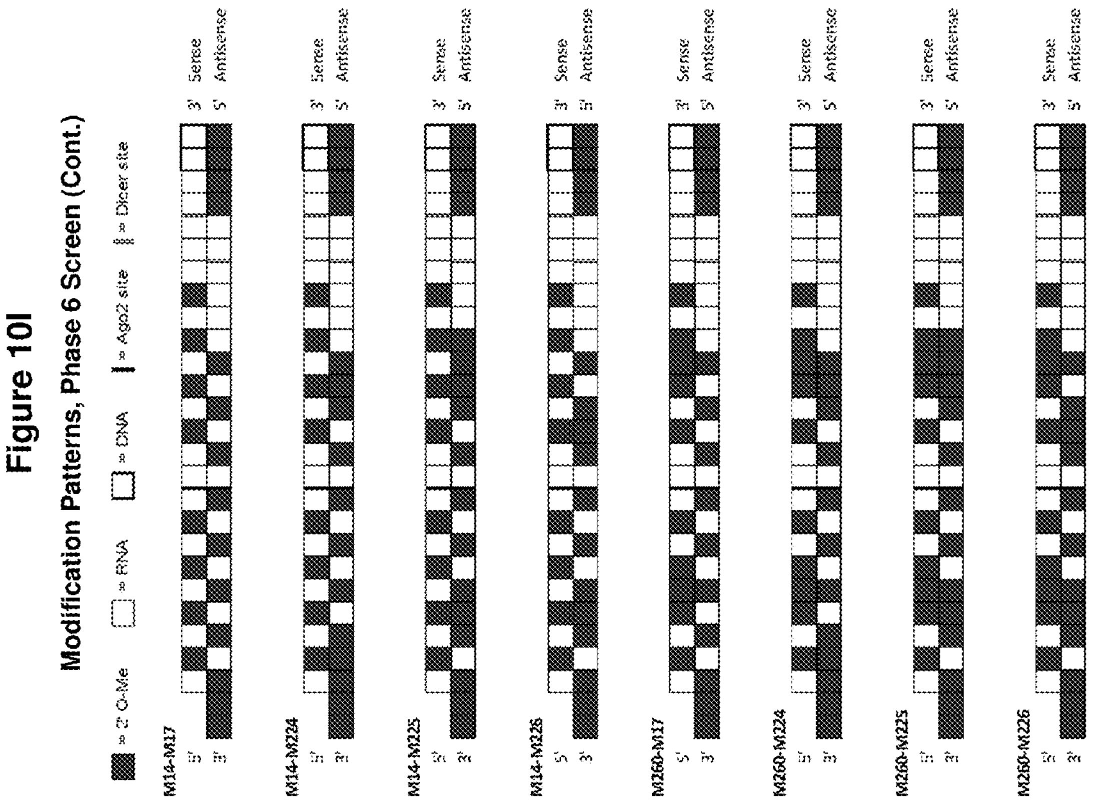
Figure 10J:
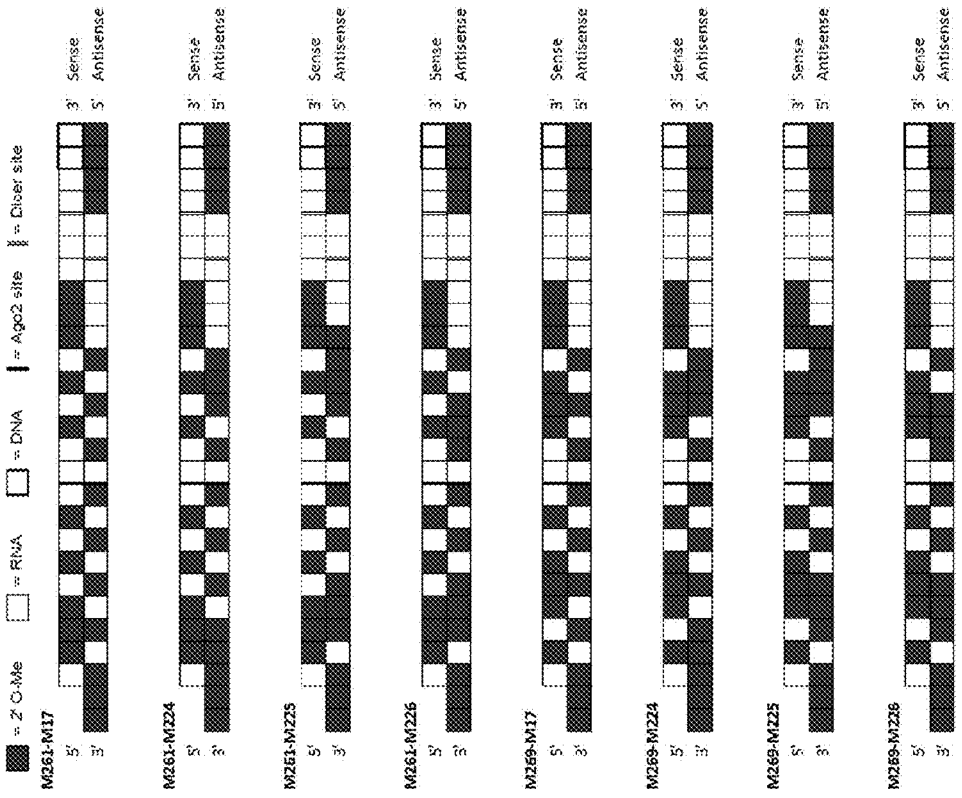
Figure 10K:
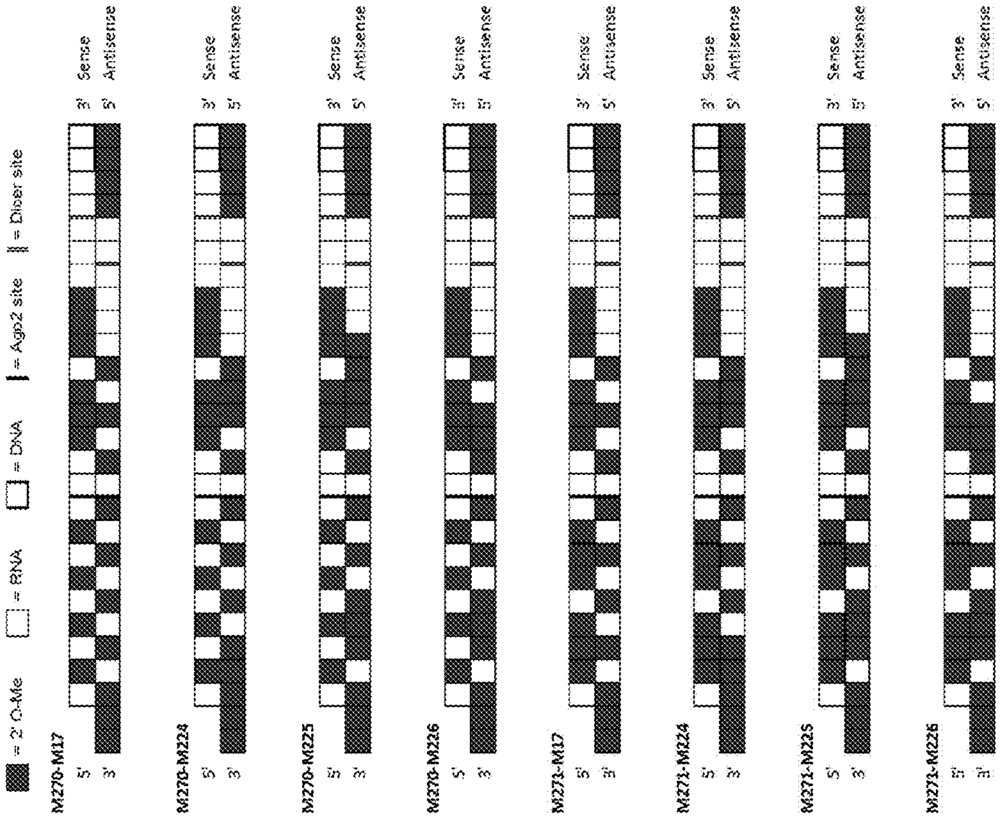
Figure 10L:
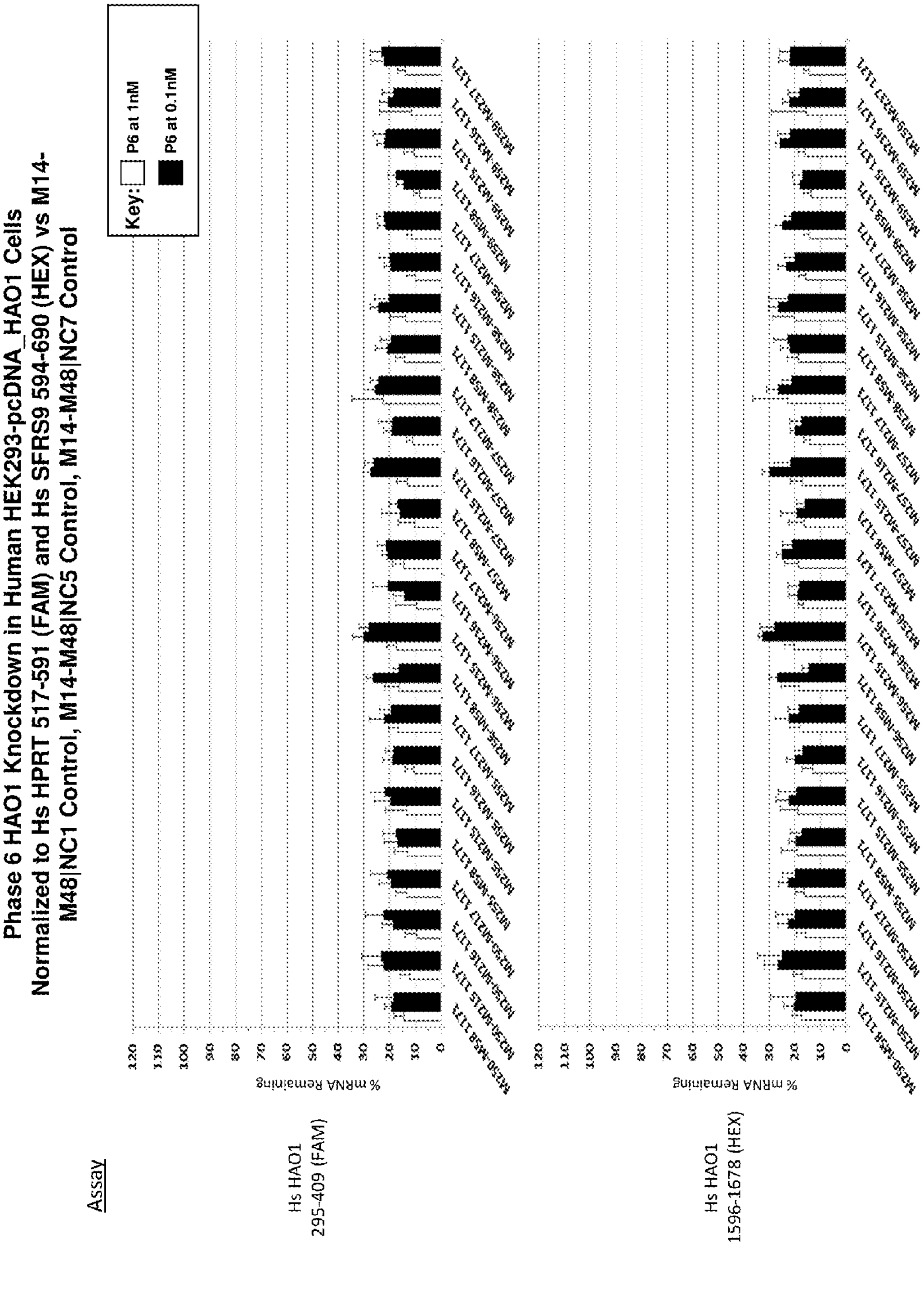
Figure 10M:
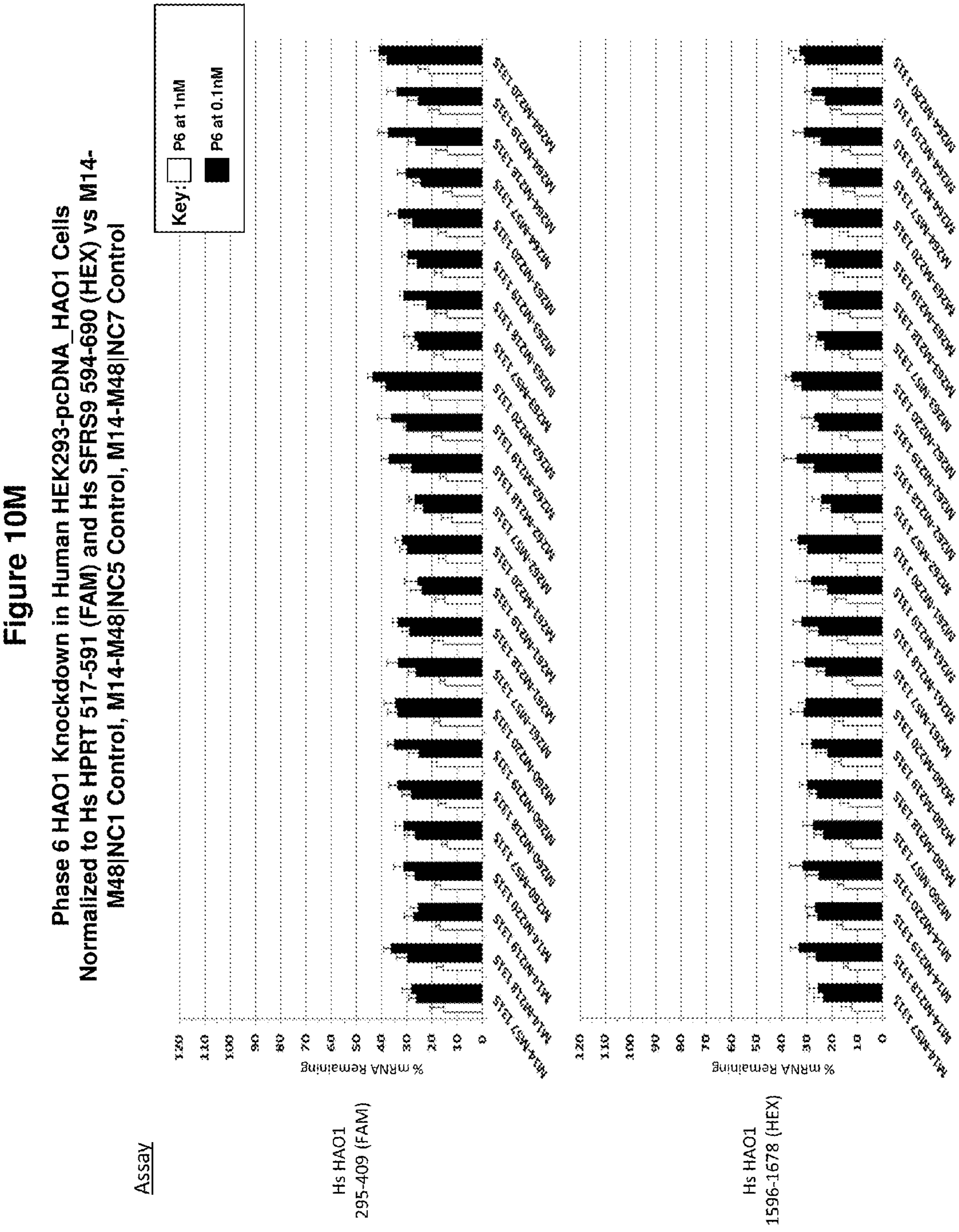
Figure 10N:
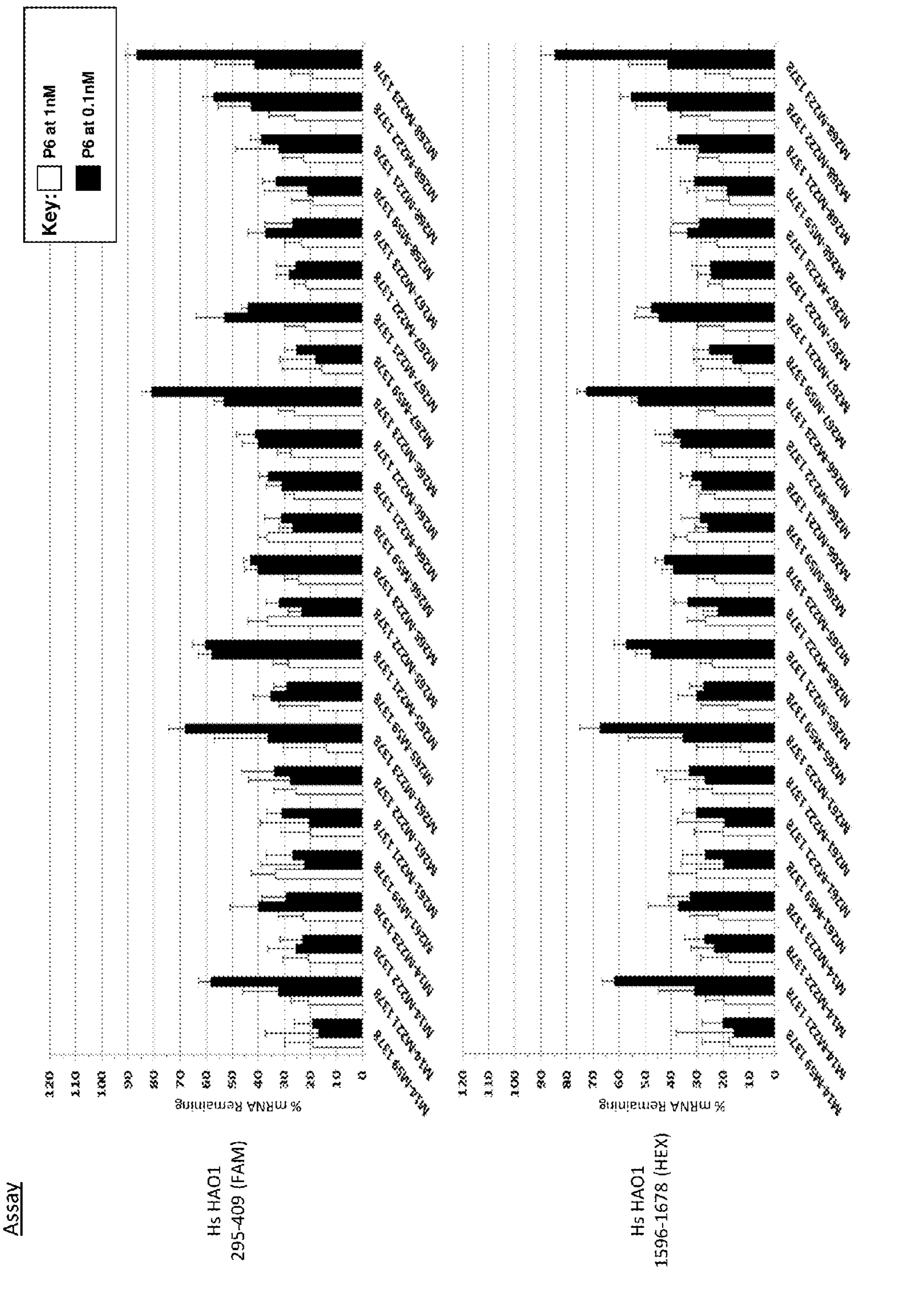
Figure 10O:
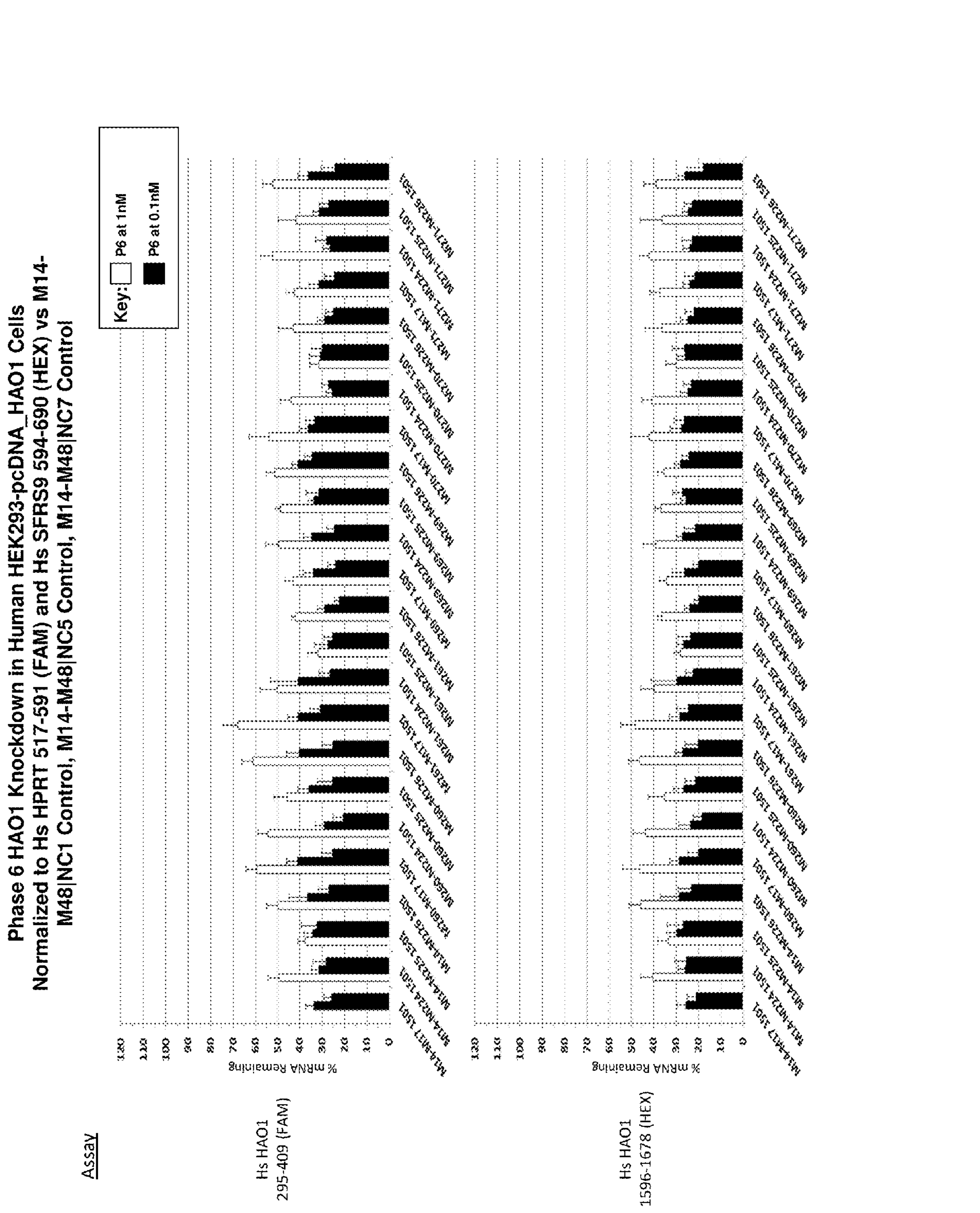

Eight duplex sequences (HAO1-m1167, m1276, m1312, m1313, m1372, m1375, m1376 and m1390, which correspond to human duplexes HAO1-1171, 1279, 1315, 1316, 1375, 1378, 1379 and 1393, respectively) were also examined for knockdown efficacy in mouse Hepal-6 cells across the same range of four duplex modification patterns (with passenger strand modification patterns varied and guide strand modification pattern fixed, in contrast to the duplexes of Example 5 above). As shown in FIGS. 8D and 8E, a majority of these duplexes showed robust HAO1 knockdown efficacy in mouse cells across a range of duplex modification patterns, at concentrations as low as 0.03 nM.

Example 7: Further Assessment of Modified Forms of Glycolate Oxidase-Targeting DsiRNAs In Vitro Further modification patterns of both passenger (sense) and guide (antisense) strands of the above 24 HAO1-targeting duplex sequences (HAO1-65, 75, 77, 80, 83, 96, 1171, 1198, 1279, 1315, 1316, 1375, 1378, 1379, 1393, 1480, 1490, 1491, 1499, 1501, 1504, 1549, 1552 and 1696) were prepared to possess 2'-O-methyl modification patterns as shown in FIGS. 9A to 9D. These heavily modified DsiRNAs were assayed for HAO1 inhibition at 1.0 nM and 0.1 nM (in duplicate) concentrations in the environment of either HeLa cells (using the luciferase reporter system, Psi-Check-HsHAO1 plasmid; FIGS. 9E to 9H) or human HEK293 cells stably transfected with HAO1 (HEK293-pcDNA_HAO1 cells; FIGS. 9I to 9L). As demonstrated in FIGS. 9D to 9L, many of the additional tested duplexes were identified to possess robust HAO1 knockdown efficacy at even 0.1 nM concentrations across the full range of extensively modified forms tested. Indeed, for all target sequences, one or more duplexes possessing extensive 2'-O-methyl modifications upon both strands was identified as a robust inhibitor of HAO1 expression. Additionally, these results confirmed the concordance between the luciferase system employed in many of the above examples (Psi-Check-HsHAO1 plasmid) and the HEK293-pcDNA_HAO1 cell stable transfectant system.

Example 8: Additional Extensively-Modified Forms of Glycolate Oxidase-Targeting DsiRNAs Were Active In Vitro Four of the above 24 HAO1-targeting duplex sequences, HAO1-1171, HAO1-1315, HAO1-1378 and HAO1-1501, were prepared to possess extensive variation in 2'-O-methyl modification patterns, as shown in FIGS. 10A to 10K. These heavily modified DsiRNAs were assayed for HAO1 inhibition at 1.0 nM and 0.1 nM (in duplicate) concentrations in the environment of stably-transfected HEK293 cells (HEK293-pcDNA_HAO1 cells; FIGS. 10L to 10O). As demonstrated in FIGS. 10L to 10O, the modified forms of HAO1-1171, HAO1-1315, and HAO1-1501 duplexes were identified to possess robust HAO1 knockdown efficacy at even 0.1 nM concentrations across the full range of extensively modified forms tested. Meanwhile, for the HAO1-1378 duplex sequence, certain of the highly modified forms showed reduced inhibitory activities at 0.1 nM when compared with other heavily modified forms (though a number of robustly active heavily 2'-O-methyl modified forms of HAO1-1378 duplexes were identified).

Figure 11A:
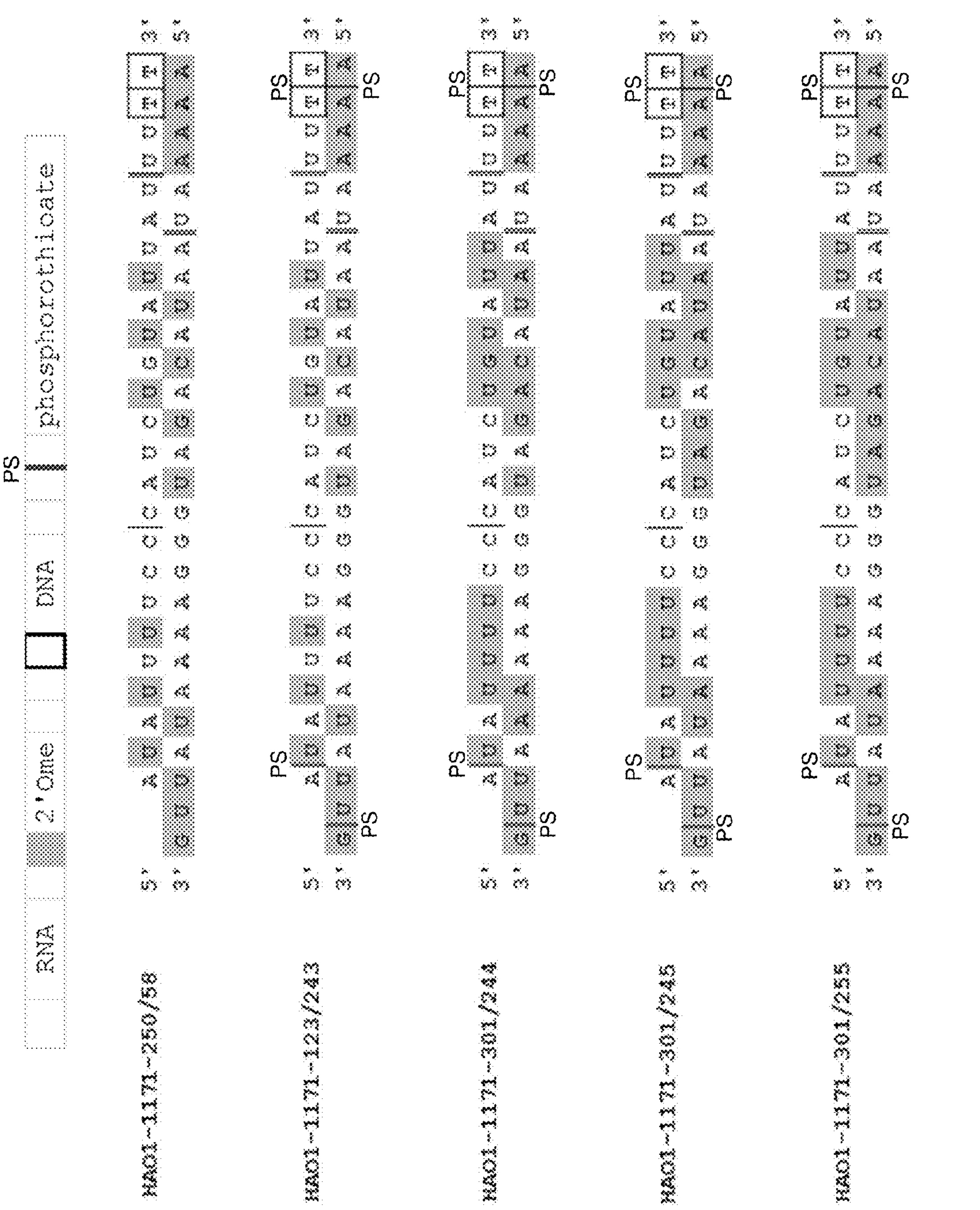
FIGS. 11A to 11F present modification patterns and sequences of HAO1-1171, HAO1-1315, HAO1-1378 and HAO1-1501 DsiRNAs, and associated inhibitory efficacy results (histograms and $IC_{50}$ curves), when assayed in HEK293 cells stably transfected with HAO1 (HEK293-pcDNA HAO1 Cells), at 0.1 nM, 0.01 nM and 0.001 nM HAO1-targeting DsiRNA concentrations.
Figure 11B:
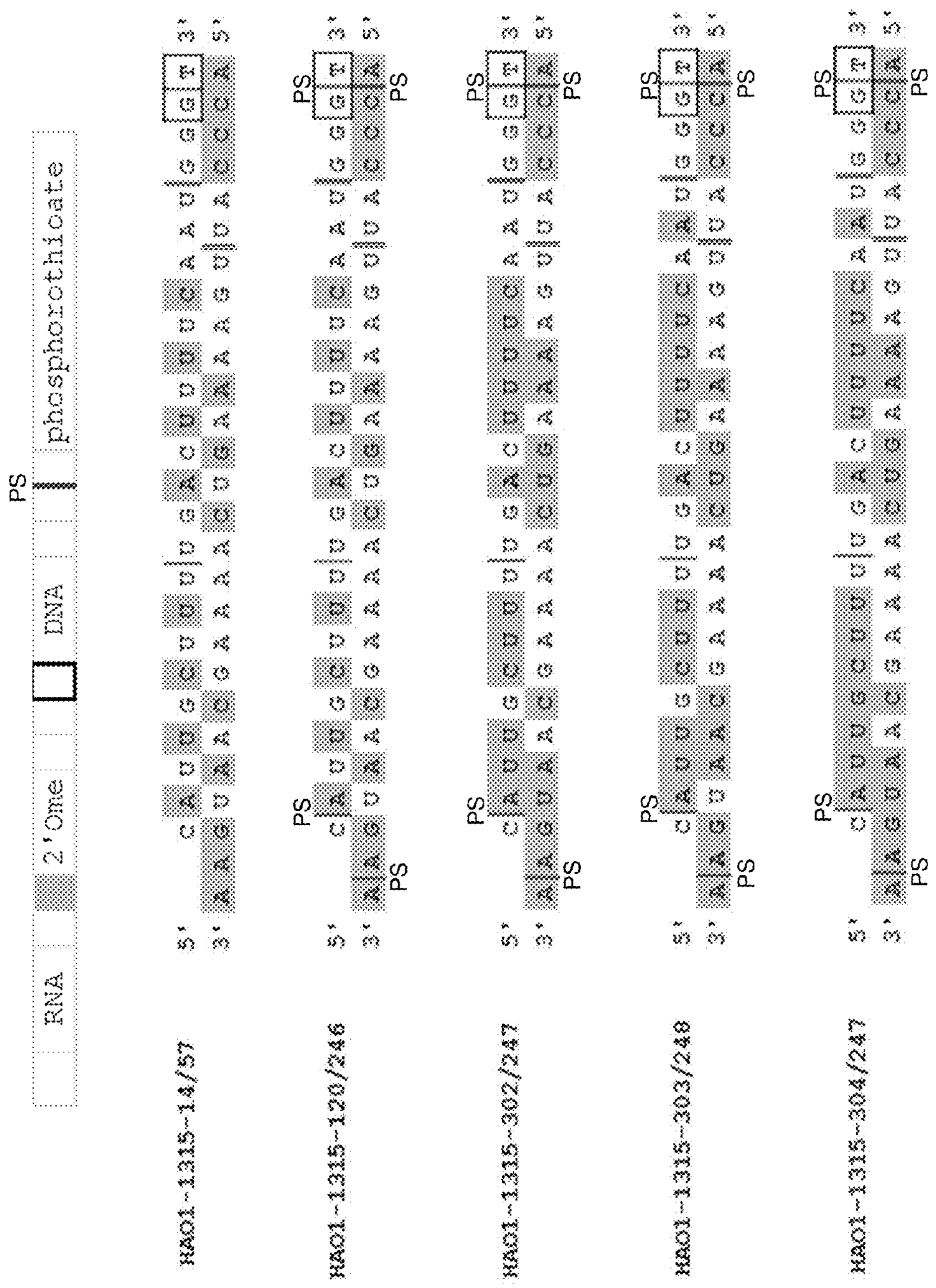
Figure 11C:
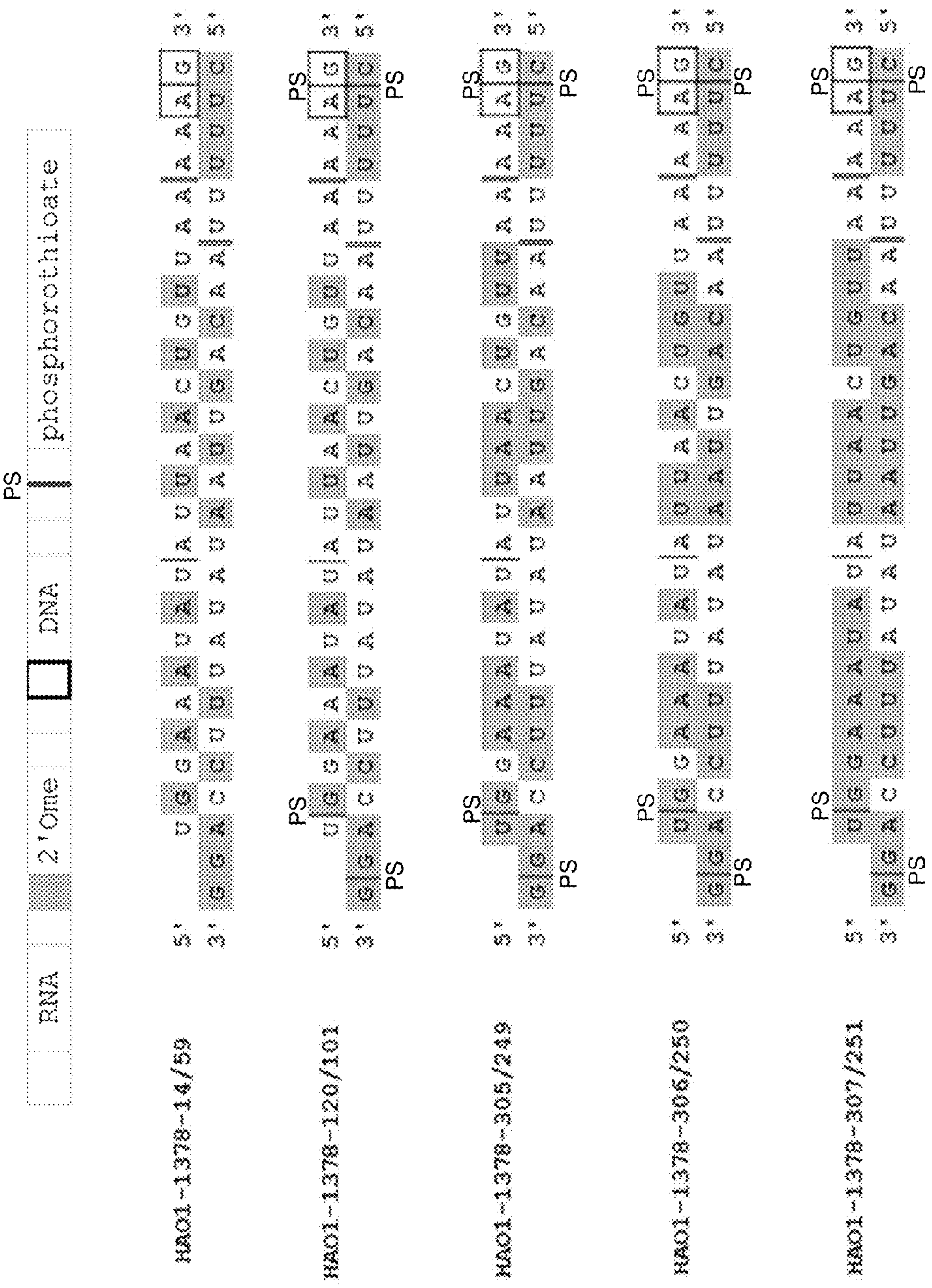
Figure 11D:
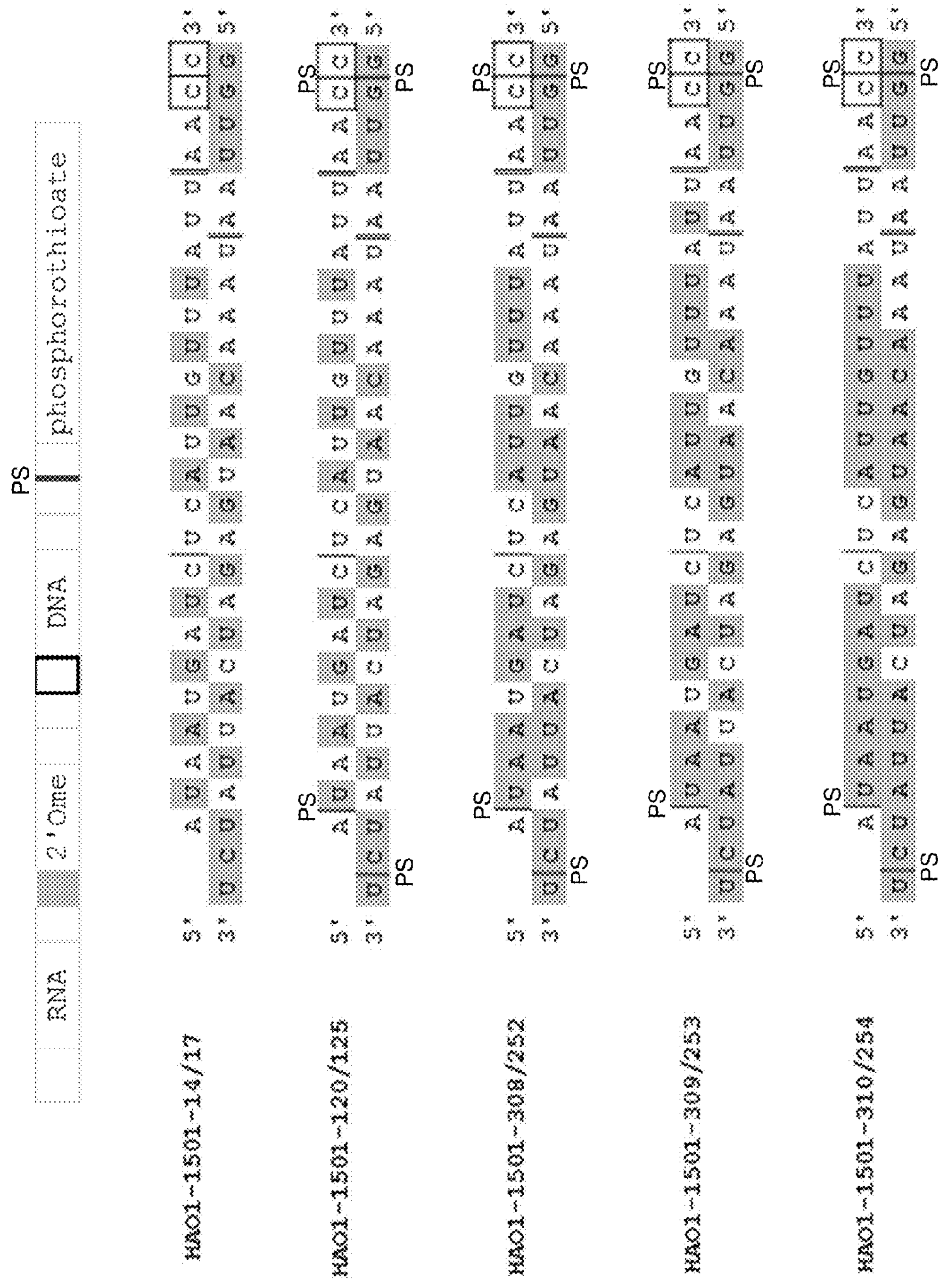
Figure 11E:
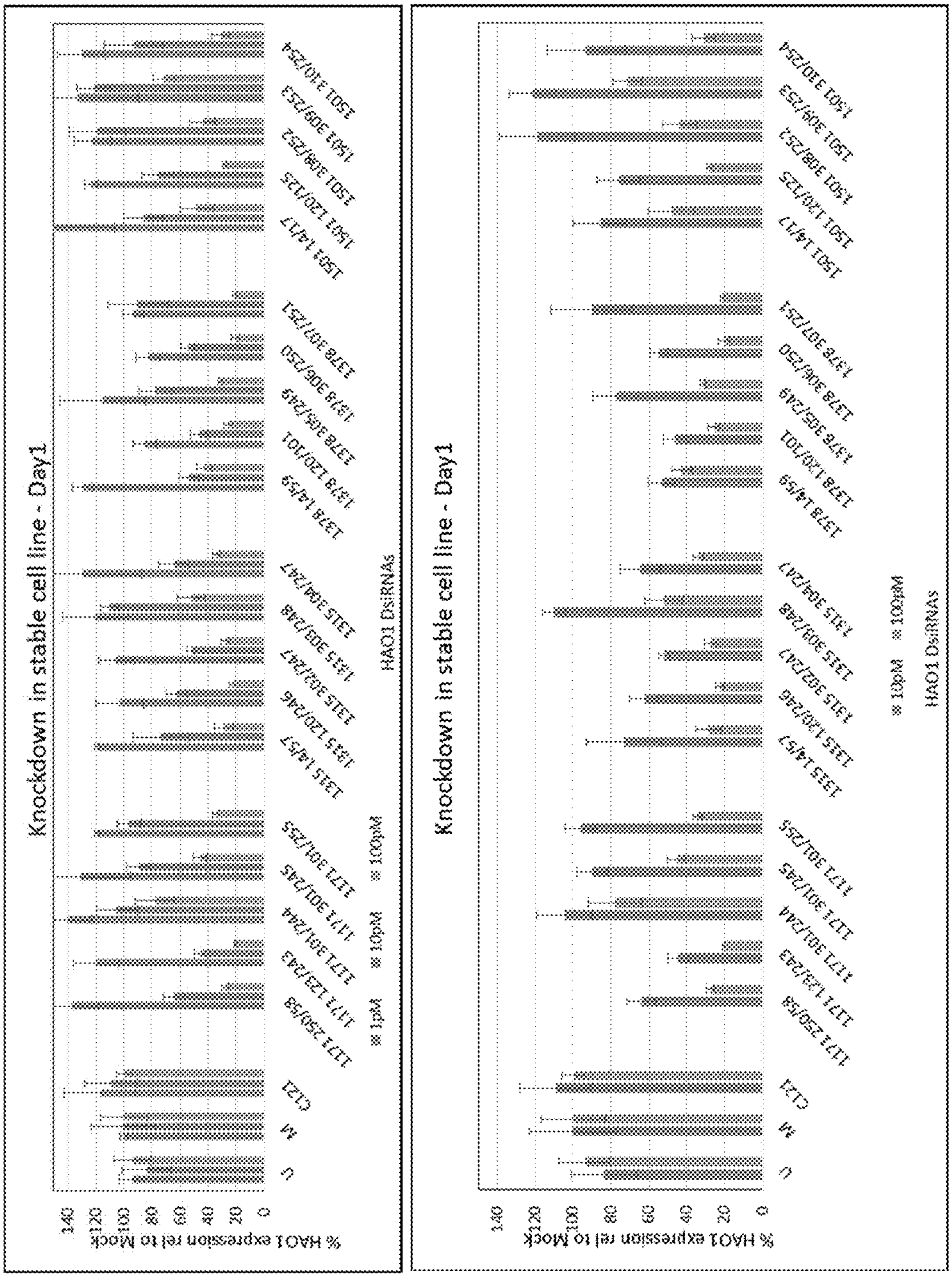
Figure 11F:
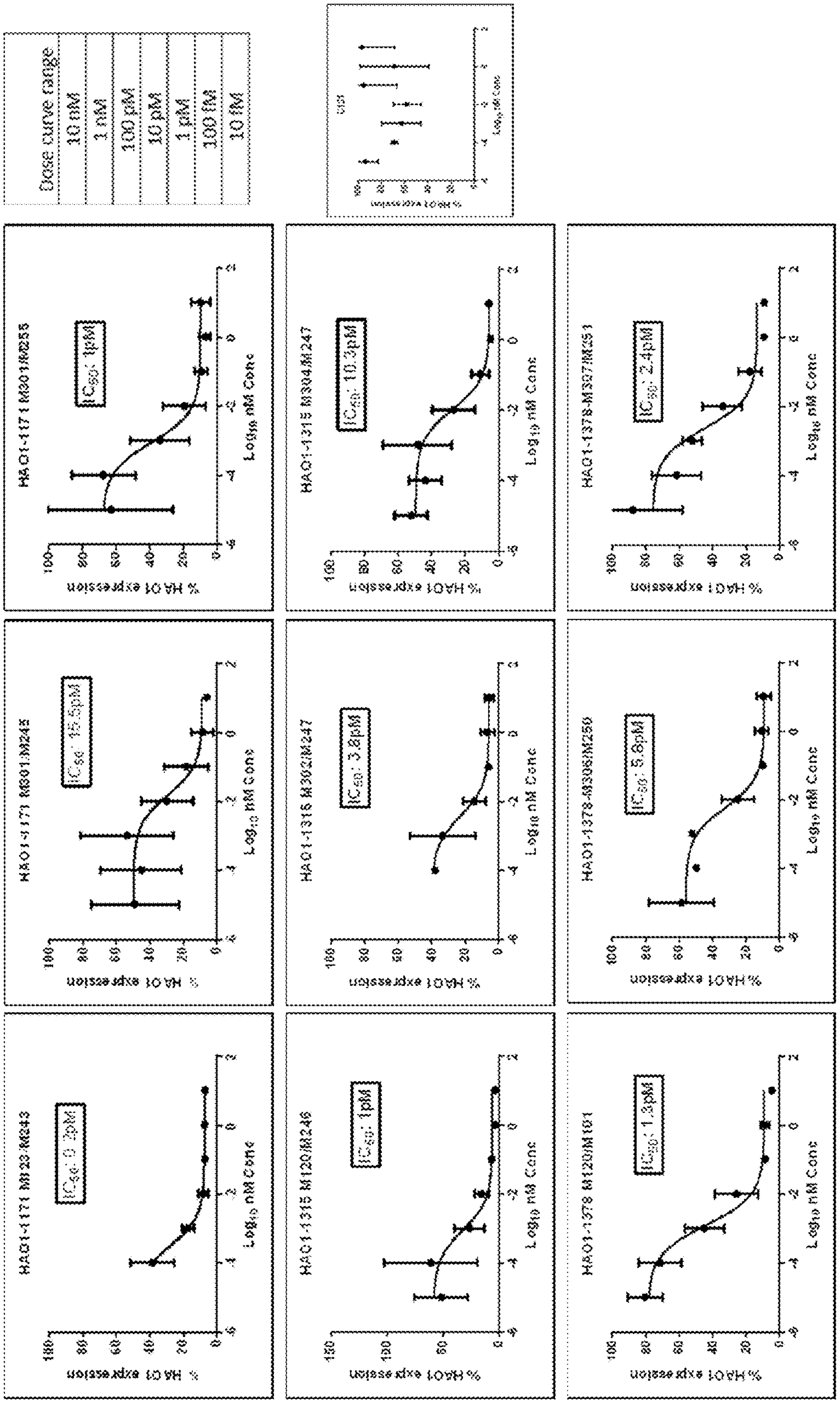

Modification of HAO1-1171, HAO1-1315, HAO1-1378 and HAO1-1501 duplexes was expanded to include phosphorothioate linkages at the final internucleotide linkages of both the 5' and 3' ends of both guide and passenger strands of variously 2'-O-methyl modified duplexes, as shown in FIGS. 11A to 11D. Five forms of each of the four duplexes were synthesized on a small scale and were tested in a stable cell line (HAO1-6-9), at doses of 100 pM, 10 pM and 1 pM, with controls. As shown in FIG. 11E, significant knockdown was observed for all duplexes tested at 100 pM and even at 10 pM for the majority of duplexes. Of the 20 forms examined, nine were selected for IC50 dose curve assessment, at concentrations ranging from 10 nM to 10 fM, decreasing in ten-fold increments, with results shown in FIG. 11F.

Figure 12E:
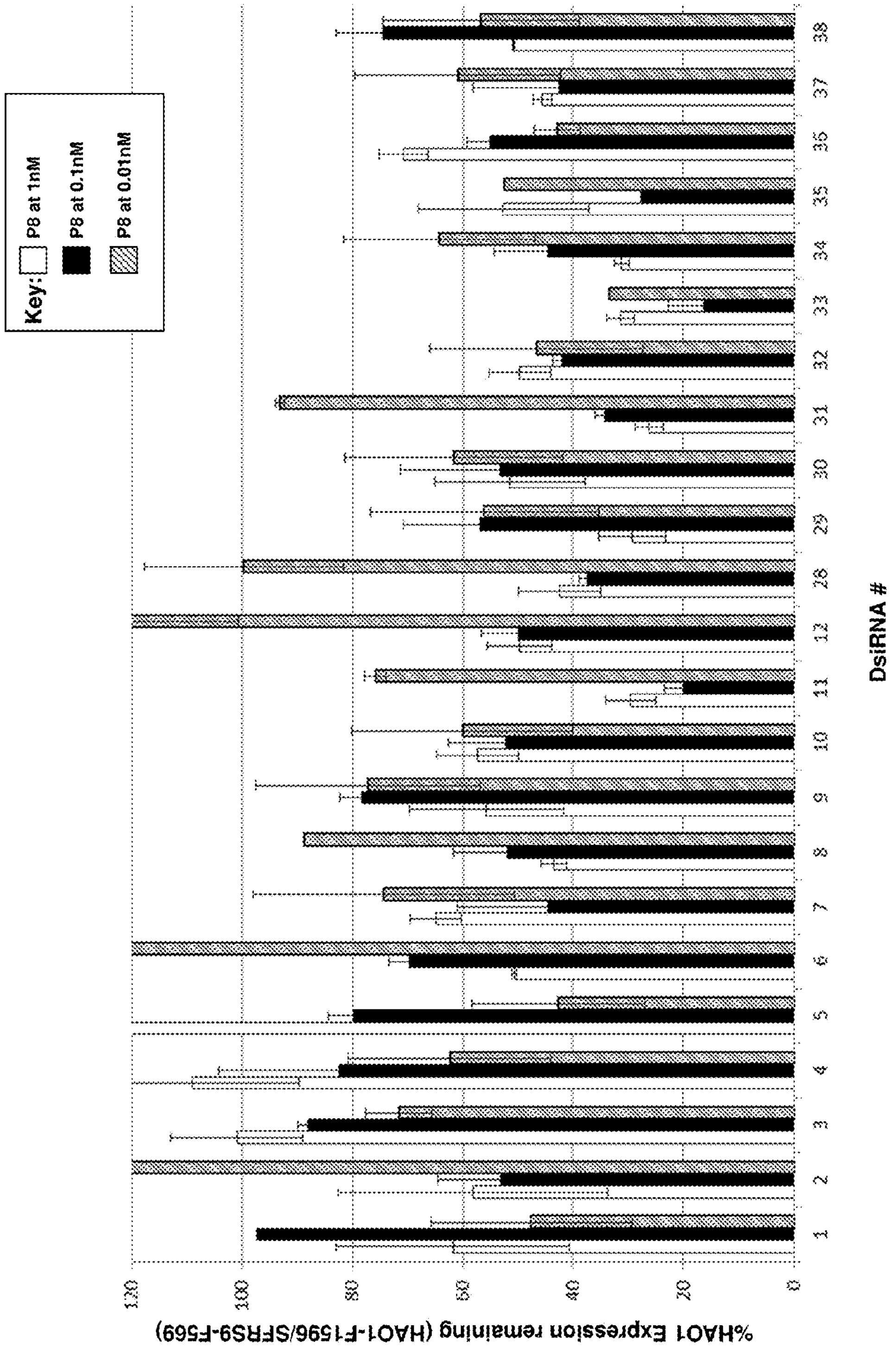
Figure 12F:
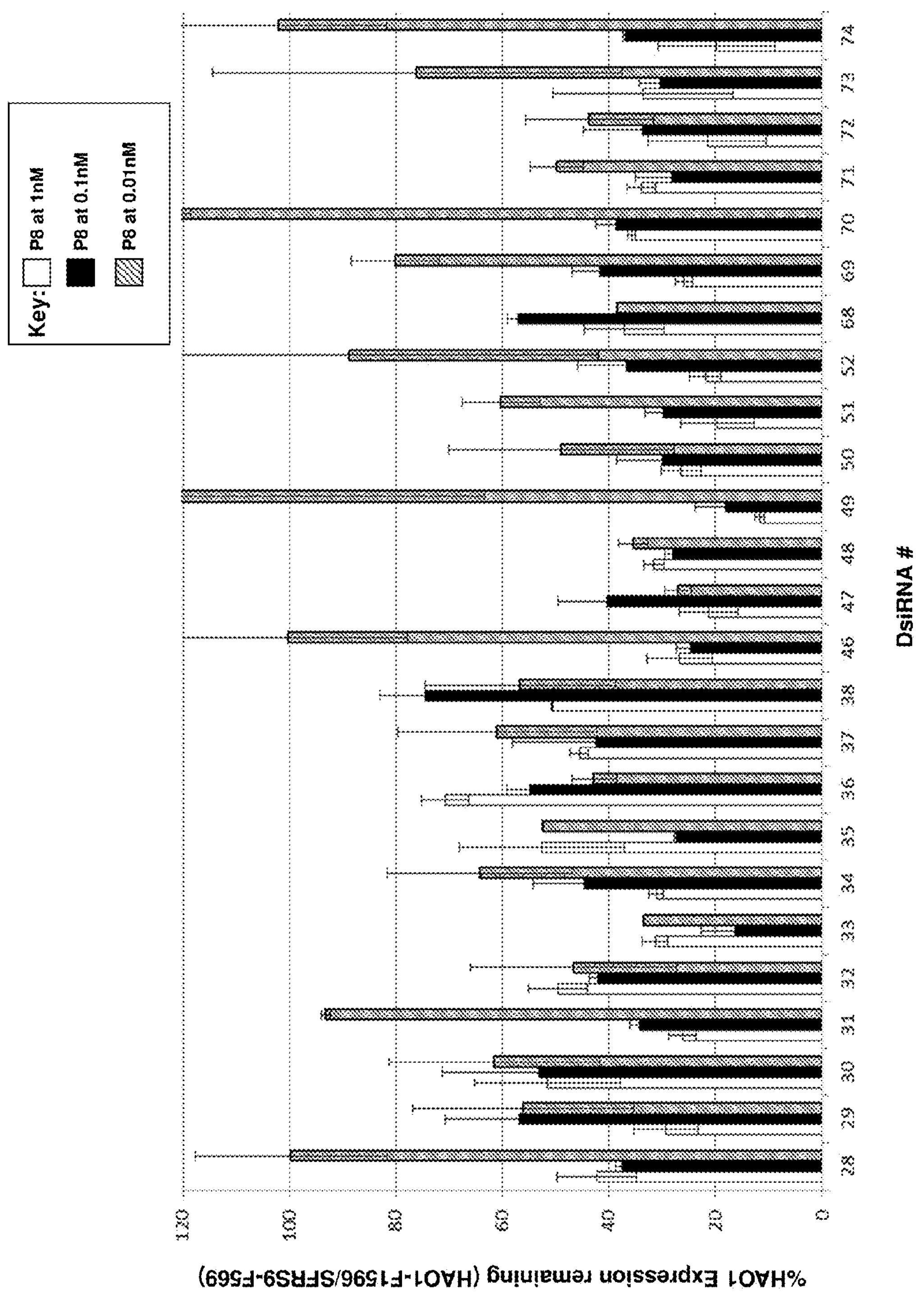

Modified forms of HAO1-1171 and HAO-1376 were further modified with 2'-fluoro and inverted basic and additional and/or alternatively positioned phosphorothioate (PS) modifications, layered upon a "parent" modification pattern, as shown in FIGS. 12A to 12D. As shown in FIGS. 12E and 12F, highly active further modified ("derivative modification pattern") forms of each "parent" modification pattern presenting duplex were identified, with significant efficacies observed at even 10 pM concentrations.

Example 9: Glycolate Oxidase-Targeting DsiRNAs Were Highly Active In Vivo

Figure 13A:
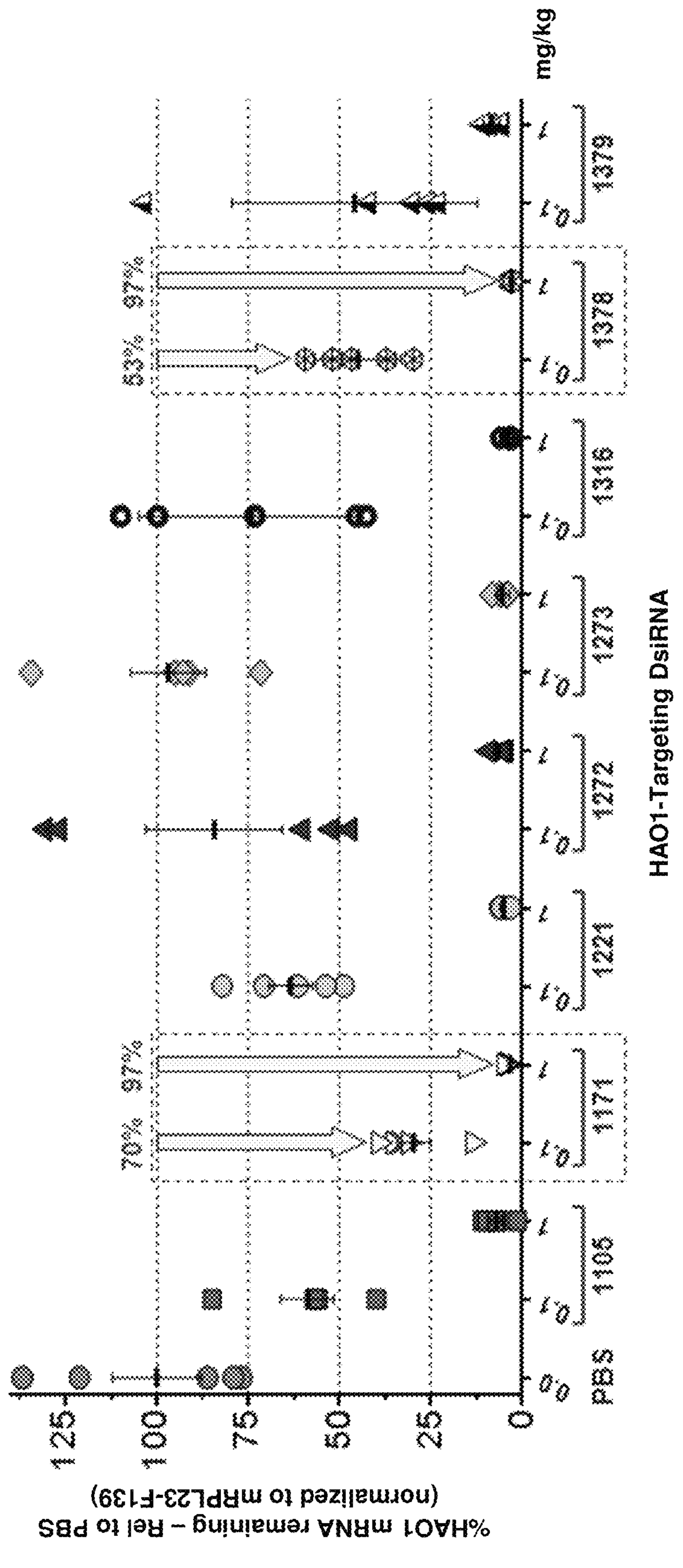
FIGS. 13A to 13L demonstrate the in vivo efficacy—including kinetics and duration of inhibition—of extensively modified forms of LNP-formulated HAO1-targeting duplexes, both in mice (FIGS. 13A to 13K) and in non-human primates (FIG. 13L).

Eight HAO1-targeting duplex sequences, HAO1-1105, HAO1-1171, HAO1-1221, HAO1-1272, HAO1-1273, HAO1-1316, HAO1-1378 and HAO1-1379, possessing an M107/M48 2'-O-methyl modification pattern, were formulated for in vivo delivery in a lipid nanoparticle (LNP) formulation (EnCore 2345). A single intravenous dose at 0.1 or 1.0 mg/kg was administered to mice (n=5 per group), and livers of treated animals were harvested at 24 hours post-administration. The extent of HAO1 mRNA knockdown in treated mouse liver was assessed by qPCR. As shown in FIG. 13A, all eight HAO1-targeting DsiRNAs tested for in vivo knockdown efficacy were active at 1.0 mg/kg doses. Notably, HAO1-1171-M107/M48 and HAO1-1378-M107/M48 duplexes exhibited robust knockdown of HAO1 in livers of treated mice even at the 0.1 mg/kg dose (showing respective levels of knockdown of approximately 70% and approximately 53%).

Figure 13B:
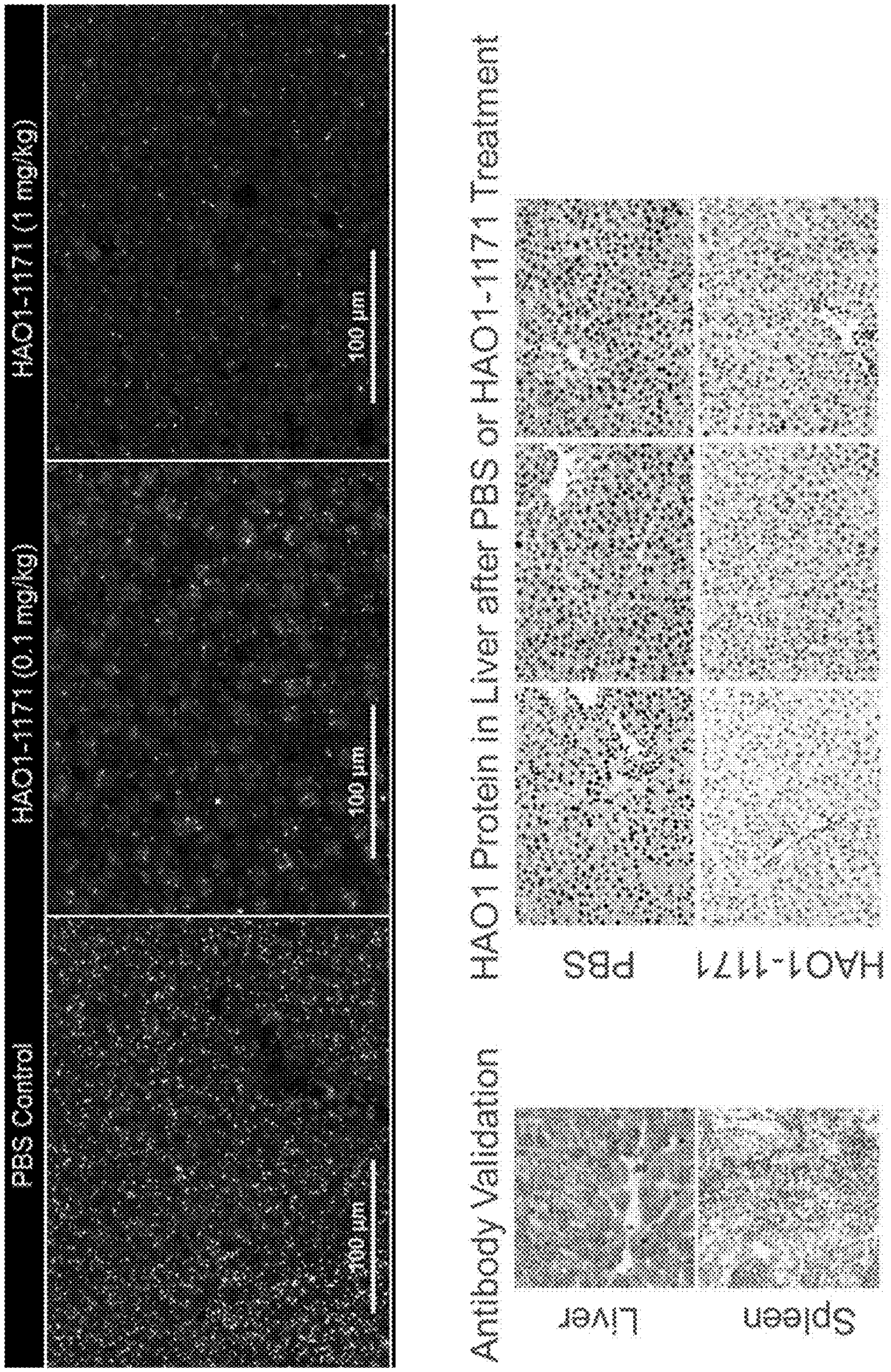

To confirm the above qPCR results, and also to verify glycolate oxidase protein knockdown, ViewRNA assays and immunohistochemistry were performed upon liver samples of treated mice. As shown in FIG. 13B, HAO1-1171-treated mice showed significant HAO1 knockdown by both ViewRNA (top panels) and immunohistochemistry.

Figure 13C:
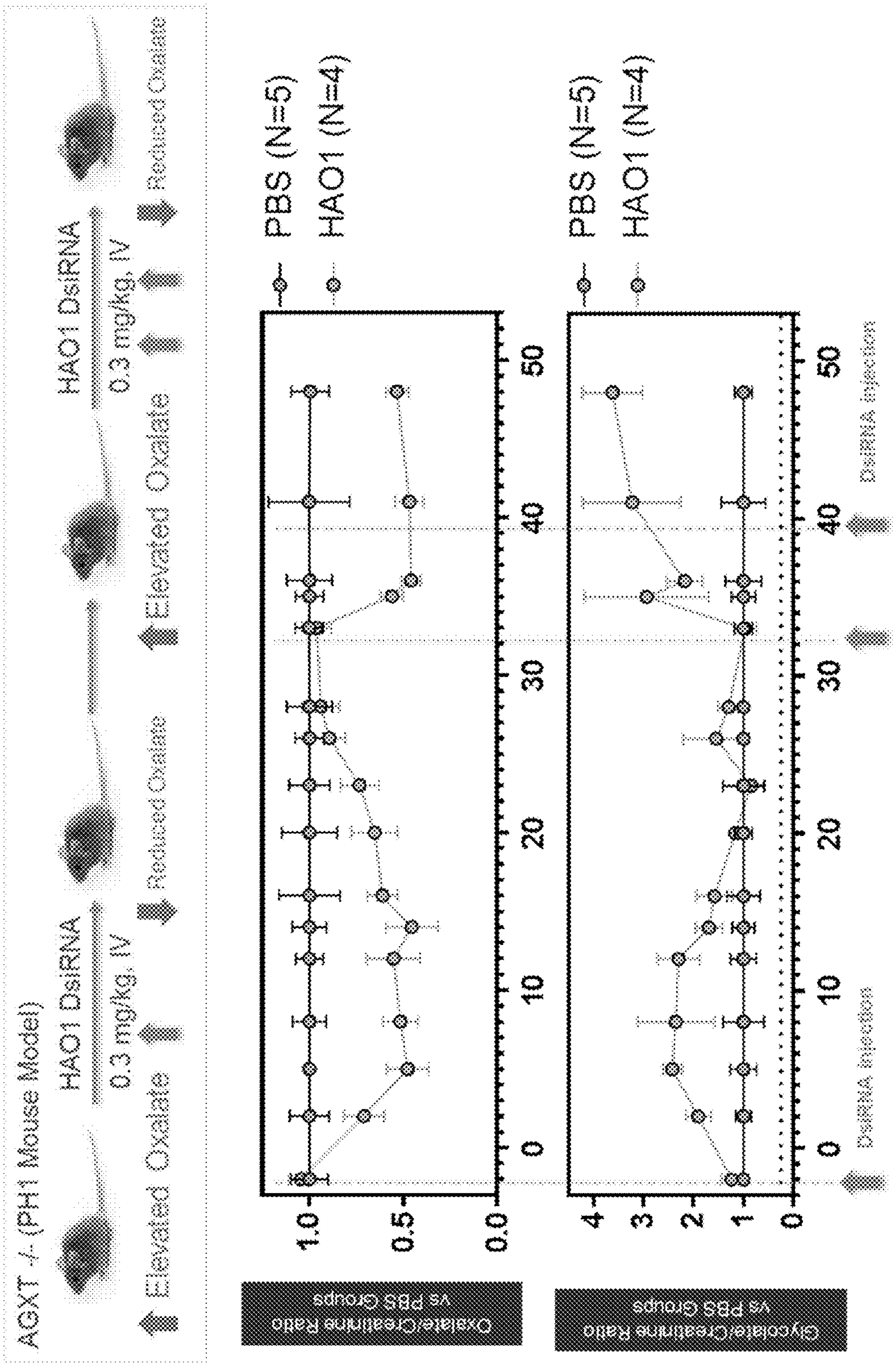

HAO1-targeting DsiRNAs were next examined for in vivo therapeutic efficacy in PH1 genetically engineered model mice. In $AGXT^{-/-}$ PH1 model mice, HAO1-targeting DsiRNA was initially intravenously administered to mice at 0.3 mg/kg. At days 32 and 39, successive additional intravenous injections of HAO1-targeting DsiRNA were administered at 0.3 mg/kg, and the effect of this dosing regimen was examined for effect upon both the oxalate/creatinine ratio and the glycolate/creatinine ratio. As shown in FIG. 13C, each administration of HAO1-targeting DsiRNA resulted in a marked decline in the oxalate/creatinine ratio of treated mice, while the glycolate/creatinine ratio of the same mice was elevated following each DsiRNA administration. Thus, formulated HAO1-targeting DsiRNA was effective at reducing the elevated oxalate levels that cause primary hyperoxaluria type 1.

Figure 13D:
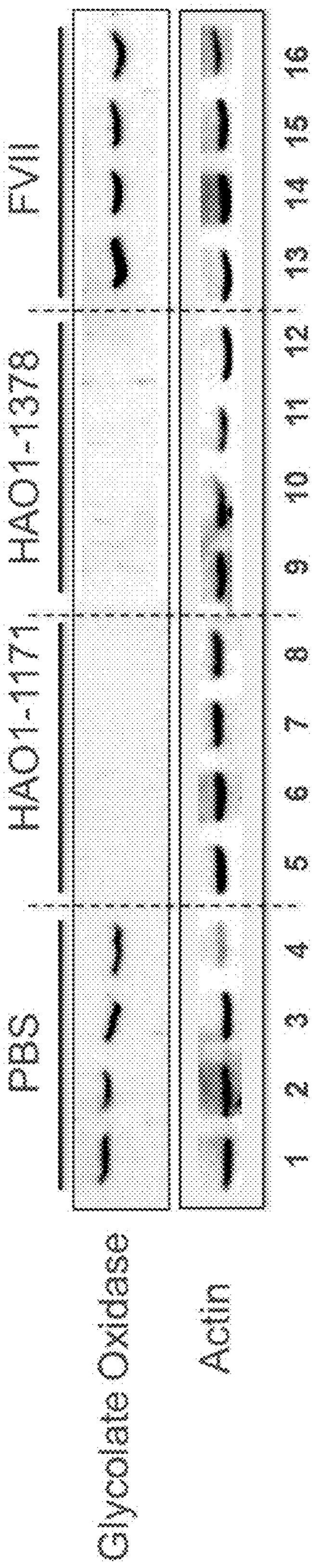

Having established the effect of HAO1-targeting DsiRNAs on the oxalate/creatinine ratio and the glycolate/creatinine ratio of treated mice, it was then examined if HAO1-targeting DsiRNAs could also reduce urine glycolate oxidase levels in treated PH1 model mice. As shown in FIG. 13D, when formulated DsiRNAs were injected on days 1, 4, 6, 10 and 14 for a total of 5 doses, into $AGXT^{-/-}$ PH1 model mice, significant reductions of glycolate oxidase protein levels in liver harvested at day 16 were observed.

Figure 13E:
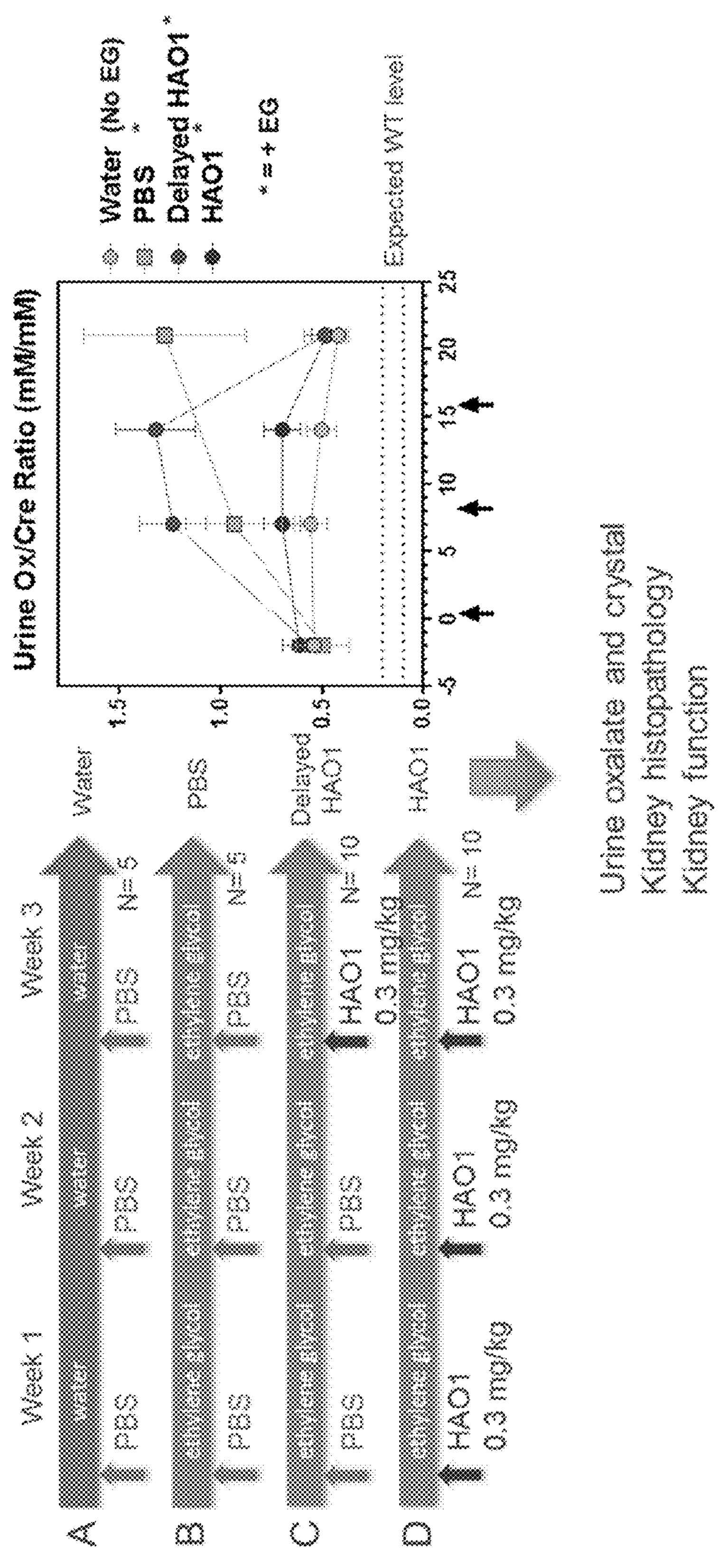

Consistent with the above-observed effects of HAO1-targeting DsiRNA administration, treatment of $AGXT^{-/-}$ PH1 model mice with HAO1-targeting DsiRNA was observed to prevent kidney damage in such mice when treated with ethylene glycol. As shown in FIG. 13E, mice administered HAO1-targeting DsiRNA at three timepoints during ethylene glycol administration were effectively protected from elevated oxalate/creatinine ratios, which were observed in control mice administered only PBS throughout ethylene glycol administration. Even a single dose of a HAO1-targeting DsiRNA at the final administration timepoint succeeded in dramatically lowering the oxalate/creatinine ratio to at or near wild type levels. Thus, kidney damage could be effectively prevented or aggressively treated with an HAO1-targeting DsiRNA of the invention.

Figure 13F:
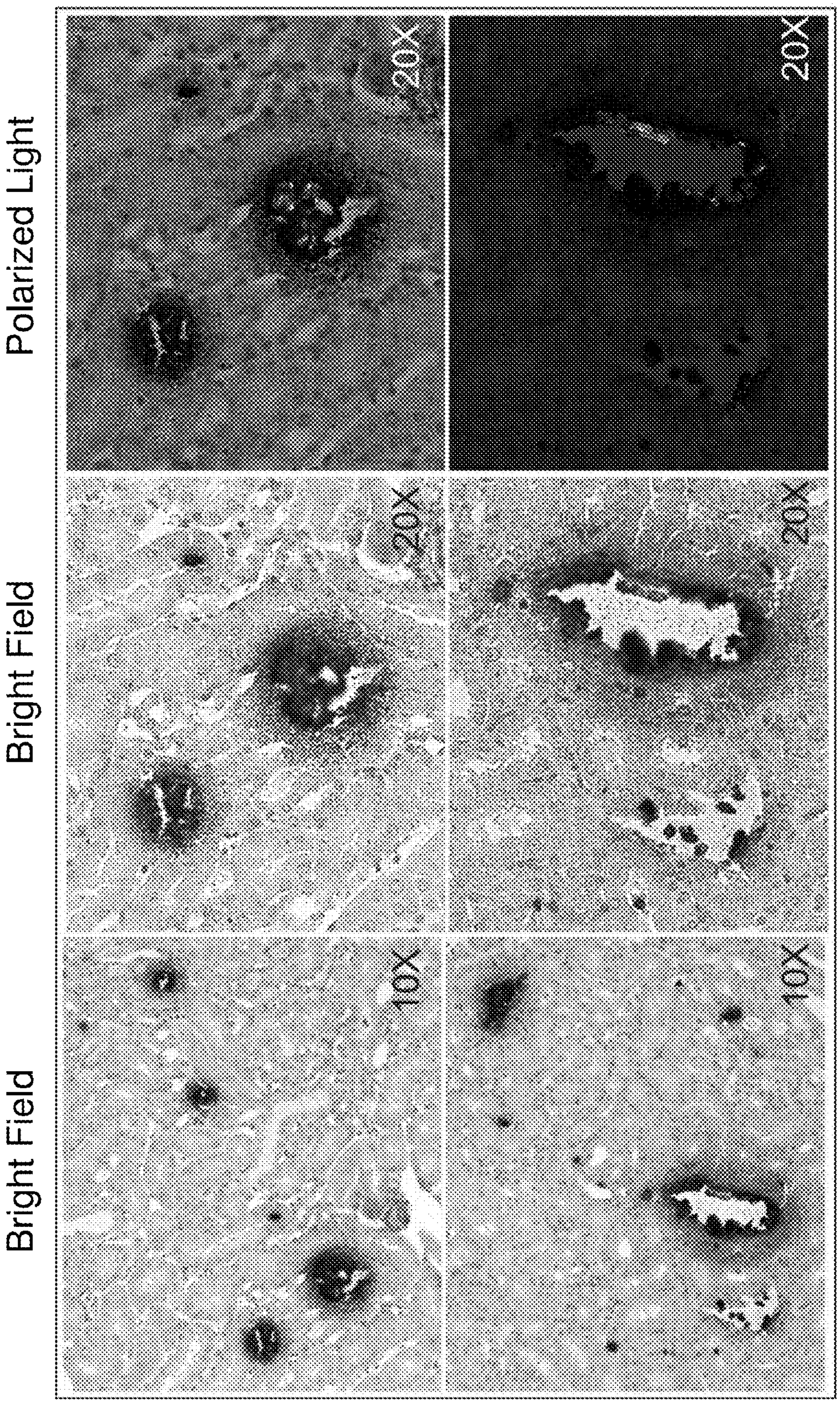
Figure 13G:
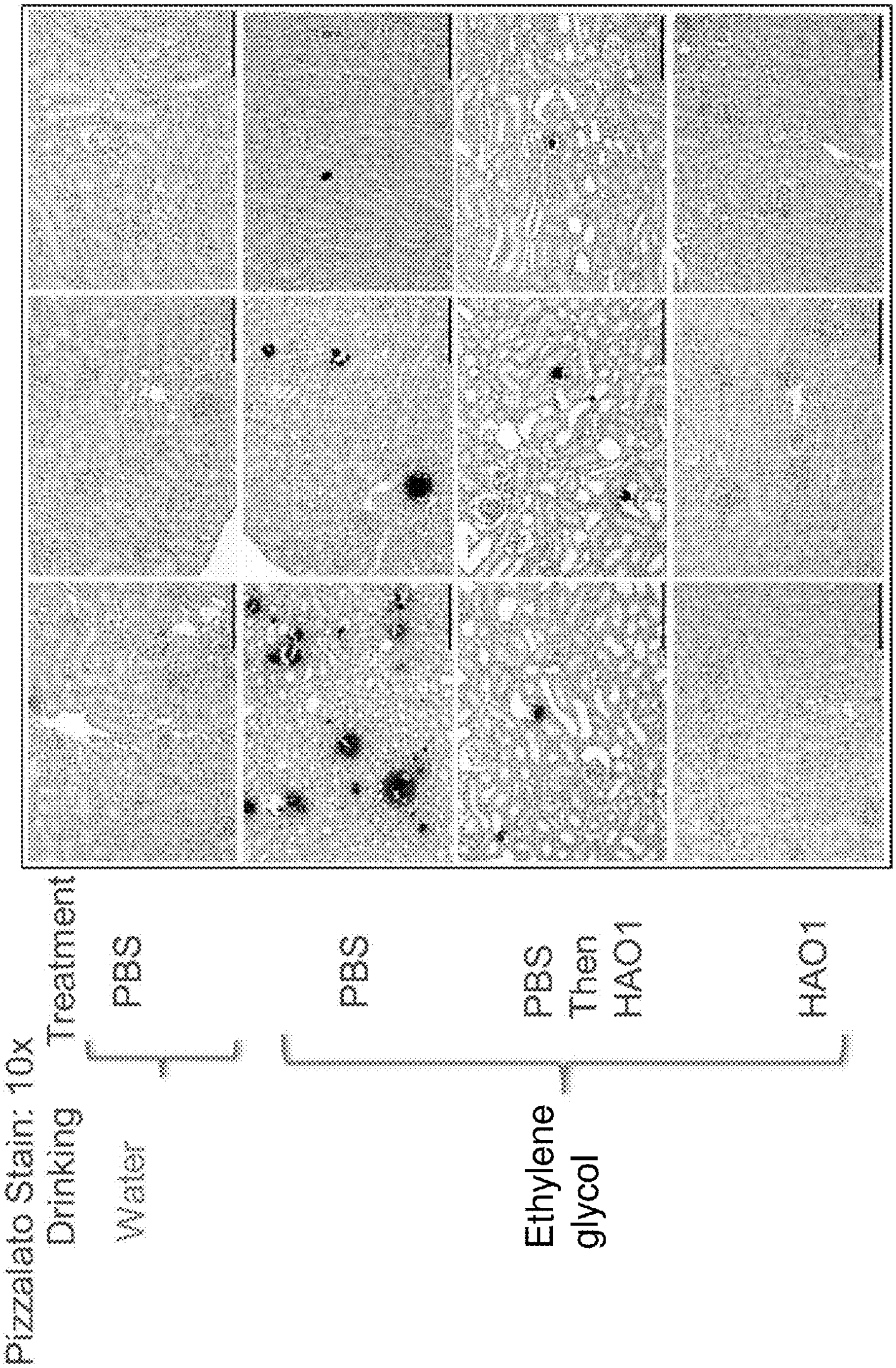
Figure 13H:
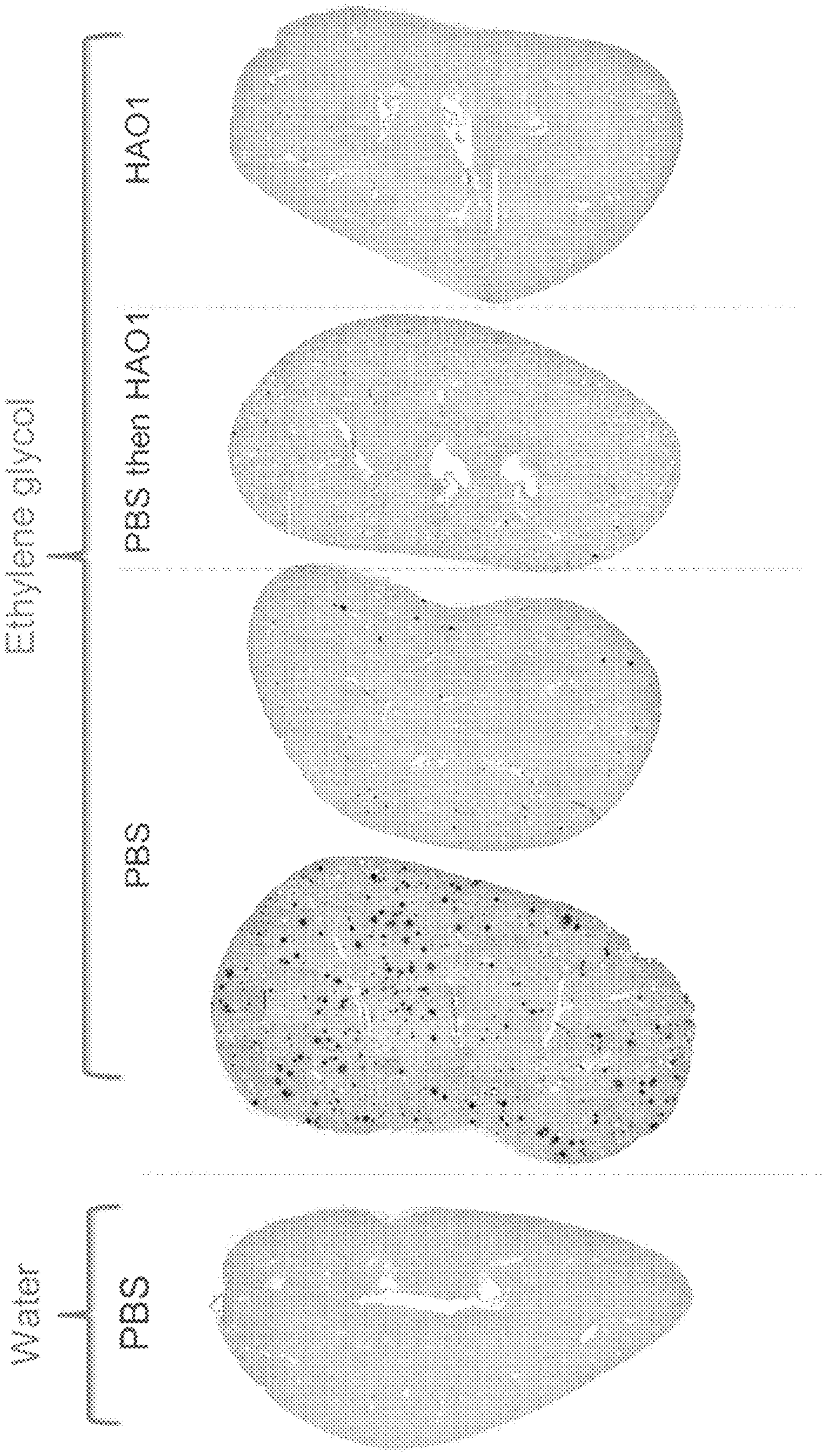

Histology confirmed the protective effect of HAO1-targeting DsiRNAs in the $AGXT^{-/-}$ PH1 mouse model. FIG. 13F shows the kidney damage that was elicited by feeding $AGXT^{-/-}$ PH1 model mice with a 0.7% ethylene glycol diet. As shown in FIGS. 13G and 13H, HAO1-targeting DsiRNA treatment effectively maintained the kidneys of a treated animal throughout ethylene glycol administration, while injection of HAO1 as only the final dose of the regimen also caused a dramatic reduction in kidney damage (as compared to mice that received no HAO1 DsiRNA treatment throughout ethylene glycol administration). Such effects were observed both in magnified sections (FIG. 13G) and at the level of the whole kidney (FIG. 13H).

Figure 13I:
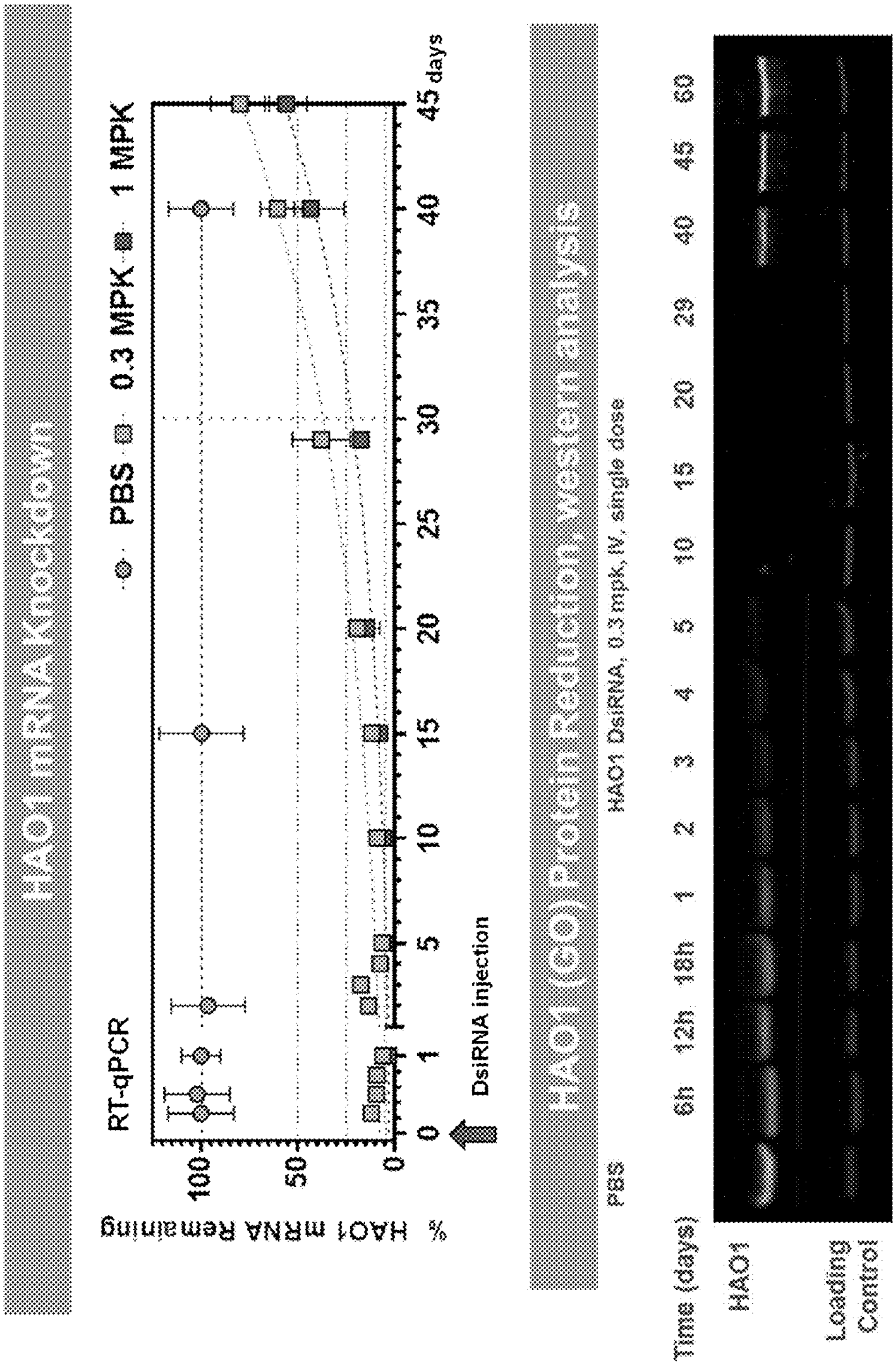
Figure 13J:
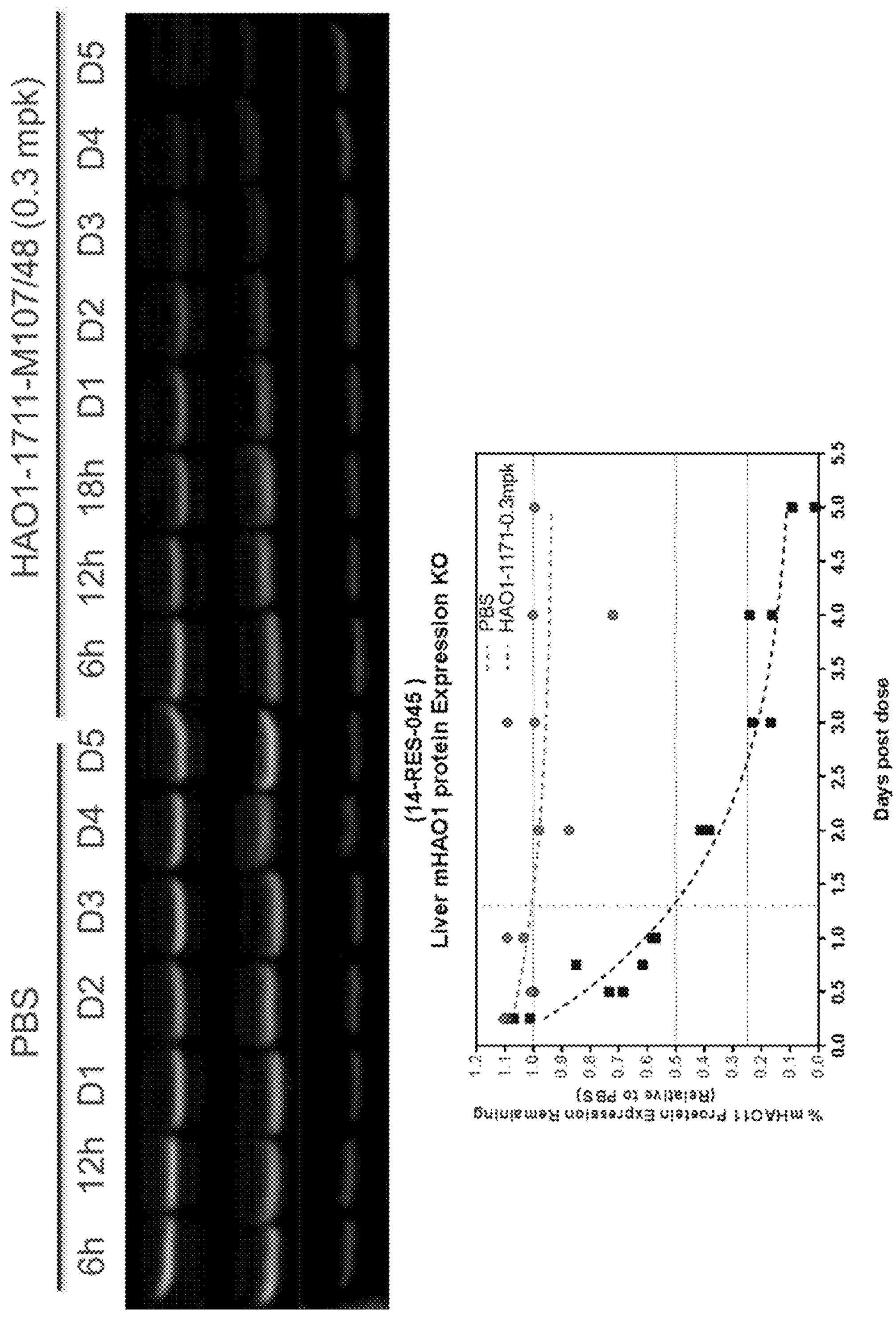

The kinetics and duration of in vivo HAO1 mRNA and protein (glycolate oxidase) inhibition were also examined. As shown in FIG. 13I, when LNP-formulated HAO-targeting DsiRNA was injected at day 0 into C57BL/6 mice at either 0.3 mg/kg or 1.0 mg/kg dosage, a dramatic reduction in levels of HAO1 mRNA was immediately observed (FIG. 13I, top panel). Consistent with the glycolate oxidase protein having a short half-life (rapid turnover rate) in vivo, the dramatic inhibition of HAO1 mRNA observed following administration of an HAO1-targeting DsiRNA produced dramatic reductions in glycolate oxidase protein levels over the 1-to-5 day timeframe post-administration (FIG. 13I, lower panel, and FIG. 13J). Indeed, the half-life of the HAO1 protein in vivo was estimated to be less than 31 hours (based upon data from two sets of animals, assessed in FIG. 13J). The effect of HAO1-targeting DsiRNA on both HAO1 mRNA and glycolate oxidase protein levels in vivo was also highly durable—even at twenty-nine days after a single administration, mRNA levels were significantly reduced and no glycolate oxidase protein was detected by western analysis. Thus, HAO1 DsiRNA achieved a rapid and highly durable in vivo silencing effect on both HAO1 mRNA and protein production.

Figure 13K:
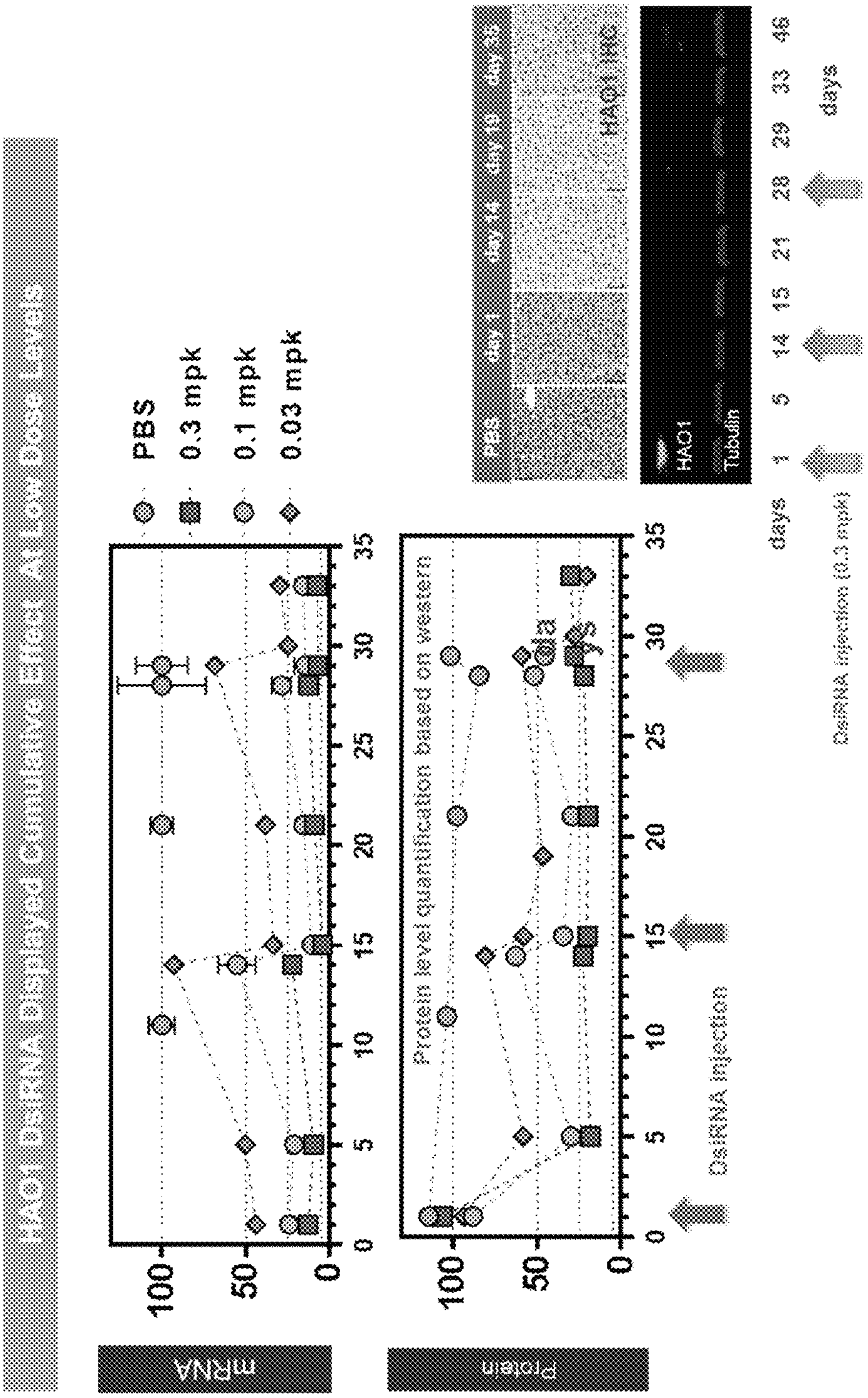

The silencing effect observed upon administration of a formulated HAO1-targeting DsiRNA was also observed to be cumulative at low dose levels. As shown in FIG. 13K, HAO1 mRNA inhibition was documented to be highly responsive to HAO1-targeting DsiRNA in vivo, While responsiveness of treated mice to HAO1-targeting DsiRNA at the HAO1 protein level was expectedly dampened as compared to that observed at the mRNA level, responsiveness at the protein level was still observed at low dose levels, further confirming the robust in vivo impact of administering LNP-formulated HAO1-targeting DsiRNAs to mice.

Figure 13L:
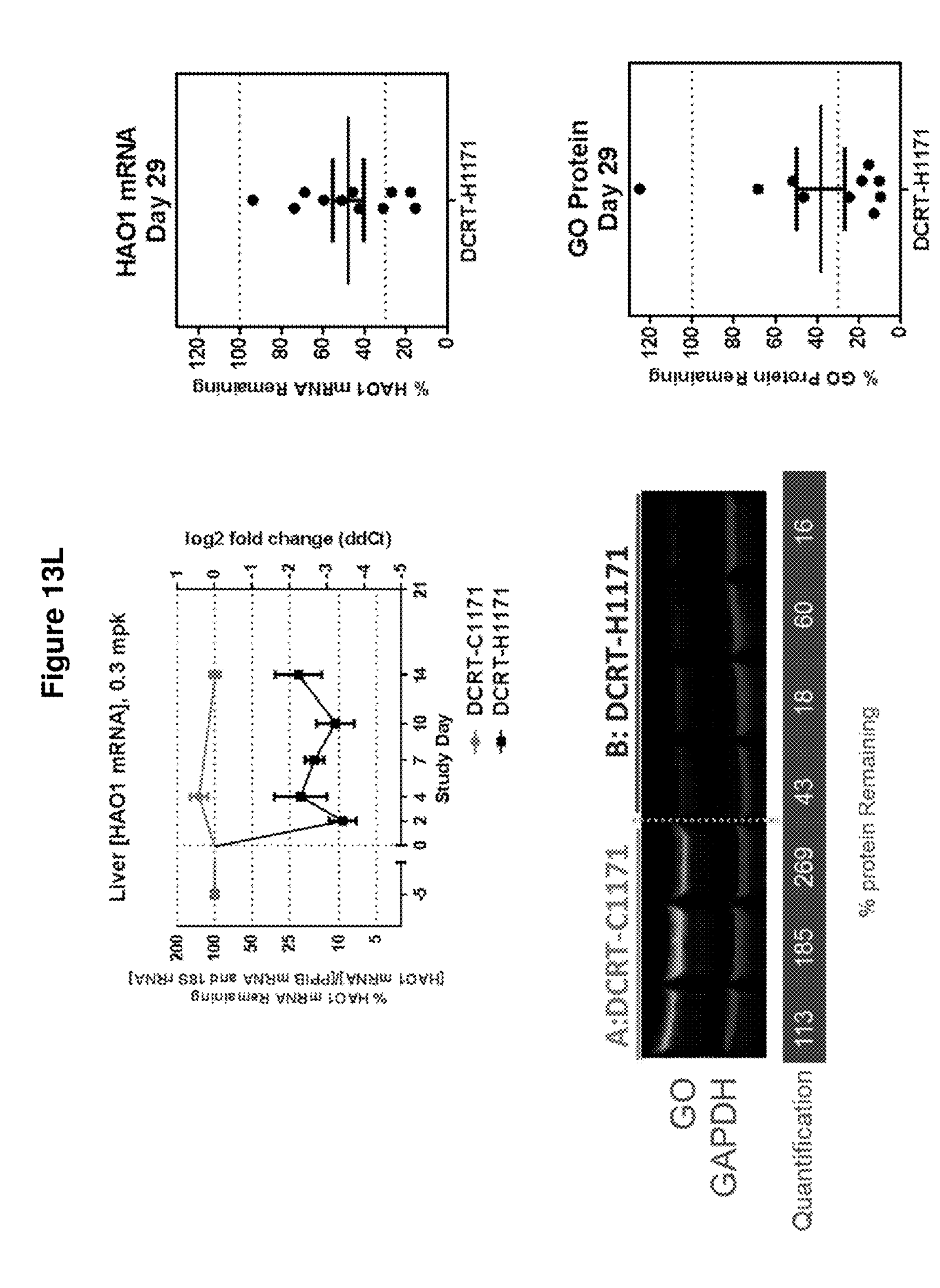

The in vivo efficacy of LNP-formulated HAO1-targeting DsiRNAs in non-human primates (NHPs) was also assessed. As shown in FIG. 13L, dramatic knockdown of both HAO1 mRNA and protein in the liver was observed in non-human primates administered an LNP-formulated HAO1-targeting DsiRNA (HAO1-1171) at 0.3 mg/kg. Consistent with the above-described mouse experiments, the inhibitory efficacy of LNP-formulated HAO1-targeting DsiRNAs was observed to be rapid, robust and of extended duration in treated non-human primates. Indeed, at 29 days post-administration, significant inhibitory efficacy persisted at both the mRNA and protein levels in non-human primates.

Thus, HAO1 DsiRNA achieved a rapid and highly durable in vivo silencing effect on both HAO1 mRNA and protein production in both mice and non-human primates.

Example 10: Indications

The present body of knowledge in HAO1 research indicates the need for methods to assay HAO1 activity and for compounds that can regulate HAO1 expression for research, diagnostic, and therapeutic use. As described herein, the nucleic acid molecules of the present invention can be used in assays to diagnose disease state related to HAO1 levels. In addition, the nucleic acid molecules can be used to treat disease state related to HAO1 functionality, misregulation, levels, etc.

Particular disorders and disease states that can be associated with HAO1 expression modulation include, but are not limited to primary hyperoxaluria 1 (PH1), including phenotypes of such disease in organs such as kidney, eye, skin, liver, etc.

Other therapeutic agents can be combined with or used in conjunction with the nucleic acid molecules (e.g. DsiRNA molecules) of the instant invention. Those skilled in the art will recognize that other compounds and therapies used to treat the diseases and conditions described herein can be combined with the nucleic acid molecules of the instant invention (e.g. siNA molecules, e.g., such as those directed to other enzymes possessing 2-hydroxyacid oxidase activity) and are hence within the scope of the instant invention. For example, for combination therapy, the nucleic acids of the invention can be prepared in one of at least two ways. First, the agents are physically combined in a preparation of nucleic acid and other agent, such as a mixture of a nucleic acid of the invention encapsulated in liposomes and other agent in a solution for intravenous administration, wherein both agents are present in a therapeutically effective concentration (e.g., the other agent in solution to deliver 1000-1250 mg/m2/day and liposome-associated nucleic acid of the invention in the same solution to deliver 0.1-100 mg/kg/ day). Alternatively, the agents are administered separately but simultaneously or successively in their respective effective doses (e.g., 1000-1250 mg/m2/d other agent and 0.1 to 100 mg/kg/day nucleic acid of the invention).

Example 11: Serum Stability for DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and can be visualized with Gelstar stain. Relative levels of protection from nuclease degradation are assessed for DsiRNAs (optionally with and without modifications).

Example 12: Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target HAO1 RNA allows the detection of mutations in a region of the HAO1 molecule, which alters the base-pairing and three-dimensional structure of the target HAO1 RNA. By using multiple DsiRNA molecules described in this invention, one can map nucleotide changes, which are important to RNA structure and function in vitro, as well as in cells and tissues. Cleavage of target HAO1 RNAs with DsiRNA molecules can be used to inhibit gene expression and define the role of specified gene products in the progression of a HAO1-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

In a specific example, DsiRNA molecules that cleave only wild-type or mutant or polymorphic forms of the target HAO1 RNA are used for the assay. The first DsiRNA molecules (i.e., those that cleave only wild-type forms of target HAO1 RNA) are used to identify wild-type HAO1 RNA present in the sample and the second DsiRNA molecules (i.e., those that cleave only mutant or polymorphic forms of target RNA) are used to identify mutant or polymorphic HAO1 RNA in the sample. As reaction controls, synthetic substrates of both wild-type and mutant or polymorphic HAO1 RNA are cleaved by both DsiRNA molecules to demonstrate the relative DsiRNA efficiencies in the reactions and the absence of cleavage of the "non-targeted" HAO1 RNA species. The cleavage products from the synthetic substrates also serve to generate size markers for the analysis of wild-type and mutant HAO1 RNAs in the sample population. Thus, each analysis requires two DsiRNA molecules, two substrates and one unknown sample, which is combined into six reactions. The presence of cleavage products is determined using an RNase protection assay so that full-length and cleavage fragments of each HAO1 RNA can be analyzed in one lane of a polyacrylamide gel. It is not absolutely required to quantify the results to gain insight into the expression of mutant or polymorphic HAO1 RNAs and putative risk of HAO1-associated phenotypic changes in target cells. The expression of HAO1 mRNA whose protein product is implicated in the development of the phenotype (i.e., disease related/associated) is adequate to establish risk. If probes of comparable specific activity are used for both transcripts, then a qualitative comparison of HAO1 RNA levels is adequate and decreases the cost of the initial diagnosis. Higher mutant or polymorphic form to wild-type ratios are correlated with higher risk whether HAO1 RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

---

LENGTHY TABLES

The patent contains a lengthy table section. A copy of the table is available in electronic form from the USPTO web site (http://seqdata.uspto.gov/?pageRequest=docDetail&DocID=US09701966B2). An electronic copy of the table will also be available from the USPTO upon request and payment of the fee set forth in 37 CFR 1.19(b)(3).

---

SEQUENCE LISTING (14860 sequences)

SEQ ID NO: 1 - DNA, 25 bp, Artificial Sequence
  Synthetic Oligonucleotide
ggcuaauuuguaucaaugauuauga

SEQ ID NO: 2 - DNA, 25 bp, Artificial Sequence
  Synthetic Oligonucleotide
gcuaauuuguaucaaugauuaugaa

SEQ ID NO: 3 - DNA, 25 bp, Artificial Sequence
  Synthetic Oligonucleotide
cuaauuuguaucaaugauuaugaac

SEQ ID NO: 4 - DNA, 25 bp, Artificial Sequence
  Synthetic Oligonucleotide
uaauuuguaucaaugauuaugaaca

SEQ ID NO: 5 - DNA, 25 bp, Artificial Sequence
  Synthetic Oligonucleotide
aauuuguaucaaugauuaugaacaa

SEQ ID NO: 6 - DNA, 25 bp, Artificial Sequence
  Synthetic Oligonucleotide
auuuguaucaaugauuaugaacaac

SEQ ID NO: 7 - DNA, 25 bp, Artificial Sequence
  Synthetic Oligonucleotide
uuuguaucaaugauuaugaacaaca

SEQ ID NO: 8 - DNA, 25 bp, Artificial Sequence
  Synthetic Oligonucleotide
uuguaucaaugauuaugaacaacat

SEQ ID NO: 9 - DNA, 25 bp, Artificial Sequence
  Synthetic Oligonucleotide
uguaucaaugauuaugaacaacatg

SEQ ID NO: 10 - DNA, 25 bp, Artificial Sequence
  Synthetic Oligonucleotide
guaucaaugauuaugaacaacaugc

SEQ ID NO: 11 - DNA, 25 bp, Artificial Sequence
  Synthetic Oligonucleotide
aucaaugauuaugaacaacaugcta

SEQ ID NO: 12 - DNA, 25 bp, Artificial Sequence
  Synthetic Oligonucleotide
ucaaugauuaugaacaacaugcuaa

SEQ ID NO: 13 - DNA, 25 bp, Artificial Sequence
  Synthetic Oligonucleotide
caaugauuaugaacaacaugcuaaa

SEQ ID NO: 14 - DNA, 25 bp, Artificial Sequence
  Synthetic Oligonucleotide
aaugauuaugaacaacaugcuaaat

SEQ ID NO: 15 - DNA, 25 bp, Artificial Sequence
  Synthetic Oligonucleotide
augauuaugaacaacaugcuaaatc

SEQ ID NO: 16 - DNA, 25 bp, Artificial Sequence
  Synthetic Oligonucleotide
ugauuaugaacaacaugcuaaauca

SEQ ID NO: 17 - DNA, 25 bp, Artificial Sequence
  Synthetic Oligonucleotide
gauuaugaacaacaugcuaaaucag

SEQ ID NO: 18 - DNA, 25 bp, Artificial Sequence
  Synthetic Oligonucleotide
auuaugaacaacaugcuaaaucagt

SEQ ID NO: 19 - DNA, 25 bp, Artificial Sequence
  Synthetic Oligonucleotide
augaacaacaugcuaaaucaguact

SEQ ID NO: 20 - DNA, 25 bp, Artificial Sequence
  Synthetic Oligonucleotide
gaacaacaugcuaaaucaguacutc

SEQ ID NO: 21 - DNA, 25 bp, Artificial Sequence
  Synthetic Oligonucleotide
aacaacaugcuaaaucaguacuucc

SEQ ID NO: 22 - DNA, 25 bp, Artificial Sequence
  Synthetic Oligonucleotide
aacaugcuaaaucaguacuuccaaa

SEQ ID NO: 23 - DNA, 25 bp, Artificial Sequence
  Synthetic Oligonucleotide
aaucaguacuuccaaagucuauata

SEQ ID NO: 24 - DNA, 25 bp, Artificial Sequence
  Synthetic Oligonucleotide
aucaguacuuccaaagucuauauat

SEQ ID NO: 25 - DNA, 25 bp, Artificial Sequence
  Synthetic Oligonucleotide
caguacuuccaaagucuauauauga

SEQ ID NO: 26 - DNA, 25 bp, Artificial Sequence
  Synthetic Oligonucleotide
aguacuuccaaagucuauauaugac

SEQ ID NO: 27 - DNA, 25 bp, Artificial Sequence
  Synthetic Oligonucleotide
guacuuccaaagucuauauaugact

SEQ ID NO: 28 - DNA, 25 bp, Artificial Sequence
  Synthetic Oligonucleotide
cuuccaaagucuauauaugacuatt

SEQ ID NO: 29 - DNA, 25 bp, Artificial Sequence
  Synthetic Oligonucleotide
ccaaagucuauauaugacuauuaca

SEQ ID NO: 30 - DNA, 25 bp, Artificial Sequence
  Synthetic Oligonucleotide
caaagucuauauaugacuauuacag

SEQ ID NO: 31 - DNA, 25 bp, Artificial Sequence
  Synthetic Oligonucleotide
aagucuauauaugacuauuacaggt

SEQ ID NO: 32 - DNA, 25 bp, Artificial Sequence
  Synthetic Oligonucleotide
uaugacuauuacaggucuggggcaa

SEQ ID NO: 33 - DNA, 25 bp, Artificial Sequence
  Synthetic Oligonucleotide
augacuauuacaggucuggggcaaa

SEQ ID NO: 34 - DNA, 25 bp, Artificial Sequence
  Synthetic Oligonucleotide
ugacuauuacaggucuggggcaaat

SEQ ID NO: 35 - DNA, 25 bp, Artificial Sequence
  Synthetic Oligonucleotide
gacuauuacaggucuggggcaaatg

SEQ ID NO: 36 - DNA, 25 bp, Artificial Sequence
  Synthetic Oligonucleotide
acuauuacaggucuggggcaaauga

SEQ ID NO: 37 - DNA, 25 bp, Artificial Sequence
  Synthetic Oligonucleotide
cuauuacaggucuggggcaaaugat

SEQ ID NO: 38 - DNA, 25 bp, Artificial Sequence
  Synthetic Oligonucleotide
uauuacaggucuggggcaaaugatg

SEQ ID NO: 39 - DNA, 25 bp, Artificial Sequence
  Synthetic Oligonucleotide
auuacaggucuggggcaaaugauga

SEQ ID NO: 40 - DNA, 25 bp, Artificial Sequence
  Synthetic Oligonucleotide
uuacaggucuggggcaaaugaugaa

SEQ ID NO: 41 - DNA, 25 bp, Artificial Sequence
  Synthetic Oligonucleotide
uacaggucuggggcaaaugaugaag

SEQ ID NO: 42 - DNA, 25 bp, Artificial Sequence
  Synthetic Oligonucleotide
acaggucuggggcaaaugaugaaga

SEQ ID NO: 43 - DNA, 25 bp, Artificial Sequence
  Synthetic Oligonucleotide
caggucuggggcaaaugaugaagaa

SEQ ID NO: 44 - DNA, 25 bp, Artificial Sequence
  Synthetic Oligonucleotide
ggaauguugcugaaacagaucugtc

SEQ ID NO: 45 - DNA, 25 bp, Artificial Sequence
  Synthetic Oligonucleotide
acuucuguuuuaggacagaggguca

SEQ ID NO: 46 - DNA, 25 bp, Artificial Sequence
  Synthetic Oligonucleotide
cuucuguuuuaggacagagggucag

SEQ ID NO: 47 - DNA, 25 bp, Artificial Sequence
  Synthetic Oligonucleotide
uacaaggccauauuugugacagugg

SEQ ID NO: 48 - DNA, 25 bp, Artificial Sequence
  Synthetic Oligonucleotide
acaaggccauauuugugacagugga

SEQ ID NO: 49 - DNA, 25 bp, Artificial Sequence
  Synthetic Oligonucleotide
ccacaacucaggaugaaaaauuutg

SEQ ID NO: 50 - DNA, 25 bp, Artificial Sequence
  Synthetic Oligonucleotide
cacaacucaggaugaaaaauuuuga

SEQ ID NO: 51 - DNA, 25 bp, Artificial Sequence
  Synthetic Oligonucleotide
acaacucaggaugaaaaauuuugaa

SEQ ID NO: 52 - DNA, 25 bp, Artificial Sequence
  Synthetic Oligonucleotide
caacucaggaugaaaaauuuugaaa

SEQ ID NO: 53 - DNA, 25 bp, Artificial Sequence
  Synthetic Oligonucleotide
aacucaggaugaaaaauuuugaaac

SEQ ID NO: 54 - DNA, 25 bp, Artificial Sequence
  Synthetic Oligonucleotide
cucaggaugaaaaauuuugaaacca

SEQ ID NO: 55 - DNA, 25 bp, Artificial Sequence
  Synthetic Oligonucleotide
ucaggaugaaaaauuuugaaaccag

SEQ ID NO: 56 - DNA, 25 bp, Artificial Sequence
  Synthetic Oligonucleotide
caggaugaaaaauuuugaaaccagt

SEQ ID NO: 57 - DNA, 25 bp, Artificial Sequence
  Synthetic Oligonucleotide
aggaugaaaaauuuugaaaccagta

SEQ ID NO: 58 - DNA, 25 bp, Artificial Sequence
  Synthetic Oligonucleotide
gaugaaaaauuuugaaaccaguact

SEQ ID NO: 59 - DNA, 25 bp, Artificial Sequence
  Synthetic Oligonucleotide
augaaaaauuuugaaaccaguactt

SEQ ID NO: 60 - DNA, 25 bp, Artificial Sequence
  Synthetic Oligonucleotide
ugaaaaauuuugaaaccaguacutt

SEQ ID NO: 61 - DNA, 25 bp, Artificial Sequence
  Synthetic Oligonucleotide
gaaaaauuuugaaaccaguacuuta

SEQ ID NO: 62 - DNA, 25 bp, Artificial Sequence
  Synthetic Oligonucleotide
aaaaauuuugaaaccaguacuuuat

SEQ ID NO: 63 - DNA, 25 bp, Artificial Sequence
  Synthetic Oligonucleotide
aaaauuuugaaaccaguacuuuatc

SEQ ID NO: 64 - DNA, 25 bp, Artificial Sequence
  Synthetic Oligonucleotide
aaauuuugaaaccaguacuuuauca

SEQ ID NO: 65 - DNA, 25 bp, Artificial Sequence
  Synthetic Oligonucleotide
aauuuugaaaccaguacuuuaucat

SEQ ID NO: 66 - DNA, 25 bp, Artificial Sequence
  Synthetic Oligonucleotide
auuuugaaaccaguacuuuaucatt

SEQ ID NO: 67 - DNA, 25 bp, Artificial Sequence
  Synthetic Oligonucleotide
uuuugaaaccaguacuuuaucautt

SEQ ID NO: 68 - DNA, 25 bp, Artificial Sequence
  Synthetic Oligonucleotide
uuugaaaccaguacuuuaucauutt

SEQ ID NO: 69 - DNA, 25 bp, Artificial Sequence
  Synthetic Oligonucleotide
uugaaaccaguacuuuaucauuutc

SEQ ID NO: 70 - DNA, 25 bp, Artificial Sequence
  Synthetic Oligonucleotide
ugaaaccaguacuuuaucauuuuct

SEQ ID NO: 71 - DNA, 25 bp, Artificial Sequence
  Synthetic Oligonucleotide
gaaaccaguacuuuaucauuuuctc

SEQ ID NO: 72 - DNA, 25 bp, Artificial Sequence
  Synthetic Oligonucleotide
aaaccaguacuuuaucauuuucucc

SEQ ID NO: 73 - DNA, 25 bp, Artificial Sequence
  Synthetic Oligonucleotide
aaccaguacuuuaucauuuucucct

SEQ ID NO: 74 - DNA, 25 bp, Artificial Sequence
  Synthetic Oligonucleotide
ccaguacuuuaucauuuucuccuga

SEQ ID NO: 75 - DNA, 25 bp, Artificial Sequence
  Synthetic Oligonucleotide
caguacuuuaucauuuucuccugag

SEQ ID NO: 76 - DNA, 25 bp, Artificial Sequence
  Synthetic Oligonucleotide
aucauuuucuccugaggaaaauutt

SEQ ID NO: 77 - DNA, 25 bp, Artificial Sequence
  Synthetic Oligonucleotide
aauggcugagaagacugacaucatt

SEQ ID NO: 78 - DNA, 25 bp, Artificial Sequence
  Synthetic Oligonucleotide
aaagggcauuuugagaggugaugat

SEQ ID NO: 79 - DNA, 25 bp, Artificial Sequence
  Synthetic Oligonucleotide
aagggcauuuugagaggugaugatg

SEQ ID NO: 80 - DNA, 25 bp, Artificial Sequence
  Synthetic Oligonucleotide
agggcauuuugagaggugaugaugc

SEQ ID NO: 81 - DNA, 25 bp, Artificial Sequence
  Synthetic Oligonucleotide
gggcauuuugagaggugaugaugcc

SEQ ID NO: 82 - DNA, 25 bp, Artificial Sequence
  Synthetic Oligonucleotide
ggcauuuugagaggugaugaugcca

SEQ ID NO: 83 - DNA, 25 bp, Artificial Sequence
  Synthetic Oligonucleotide
gcauuuugagaggugaugaugccag

SEQ ID NO: 84 - DNA, 25 bp, Artificial Sequence
  Synthetic Oligonucleotide
cauuuugagaggugaugaugccagg

SEQ ID NO: 85 - DNA, 25 bp, Artificial Sequence
  Synthetic Oligonucleotide
auuuugagaggugaugaugccaggg

SEQ ID NO: 86 - DNA, 25 bp, Artificial Sequence
  Synthetic Oligonucleotide
uuuugagaggugaugaugccaggga

SEQ ID NO: 87 - DNA, 25 bp, Artificial Sequence
  Synthetic Oligonucleotide
uuugagaggugaugaugccagggag

SEQ ID NO: 88 - DNA, 25 bp, Artificial Sequence
  Synthetic Oligonucleotide
uugagaggugaugaugccagggagg

SEQ ID NO: 89 - DNA, 25 bp, Artificial Sequence
  Synthetic Oligonucleotide
augggaucuuggugucgaaucaugg

SEQ ID NO: 90 - DNA, 25 bp, Artificial Sequence
  Synthetic Oligonucleotide
ugggaucuuggugucgaaucauggg

SEQ ID NO: 91 - DNA, 25 bp, Artificial Sequence
  Synthetic Oligonucleotide
gggaucuuggugucgaaucaugggg

SEQ ID NO: 92 - DNA, 25 bp, Artificial Sequence
  Synthetic Oligonucleotide
ggaucuuggugucgaaucauggggc

SEQ ID NO: 93 - DNA, 25 bp, Artificial Sequence
  Synthetic Oligonucleotide
gaucuuggugucgaaucauggggct

SEQ ID NO: 94 - DNA, 25 bp, Artificial Sequence
  Synthetic Oligonucleotide
aucuuggugucgaaucauggggctc

SEQ ID NO: 95 - DNA, 25 bp, Artificial Sequence
  Synthetic Oligonucleotide
ucuuggugucgaaucauggggcucg

SEQ ID NO: 96 - DNA, 25 bp, Artificial Sequence
  Synthetic Oligonucleotide
cuuggugucgaaucauggggcucga

SEQ ID NO: 97 - DNA, 25 bp, Artificial Sequence
  Synthetic Oligonucleotide
uuggugucgaaucauggggcucgac

SEQ ID NO: 98 - DNA, 25 bp, Artificial Sequence
  Synthetic Oligonucleotide
uggugucgaaucauggggcucgaca

SEQ ID NO: 99 - DNA, 25 bp, Artificial Sequence
  Synthetic Oligonucleotide
ccacuauugauguucugccagaaat

SEQ ID NO: 100 - DNA, 25 bp, Artificial Sequence
  Synthetic Oligonucleotide
cuauugauguucugccagaaauugt

SEQ ID NO: 101 - DNA, 25 bp, Artificial Sequence
  Synthetic Oligonucleotide
uauugauguucugccagaaauugtg

SEQ ID NO: 102 - DNA, 25 bp, Artificial Sequence
  Synthetic Oligonucleotide
gaggcuguggaagggaagguggaag

SEQ ID NO: 103 - DNA, 25 bp, Artificial Sequence
  Synthetic Oligonucleotide
aggcuguggaagggaagguggaagt

SEQ ID NO: 104 - DNA, 25 bp, Artificial Sequence
  Synthetic Oligonucleotide
ggagaaagguguucaagaugucctc

SEQ ID NO: 105 - DNA, 25 bp, Artificial Sequence
  Synthetic Oligonucleotide
gagaaagguguucaagauguccucg

SEQ ID NO: 106 - DNA, 25 bp, Artificial Sequence
  Synthetic Oligonucleotide
agaaagguguucaagauguccucga

SEQ ID NO: 107 - DNA, 25 bp, Artificial Sequence
  Synthetic Oligonucleotide
gaaagguguucaagauguccucgag

SEQ ID NO: 108 - DNA, 25 bp, Artificial Sequence
  Synthetic Oligonucleotide
aaagguguucaagauguccucgaga

SEQ ID NO: 109 - DNA, 25 bp, Artificial Sequence
  Synthetic Oligonucleotide
aagguguucaagauguccucgagat

SEQ ID NO: 110 - DNA, 25 bp, Artificial Sequence
  Synthetic Oligonucleotide
agguguucaagauguccucgagata

SEQ ID NO: 111 - DNA, 25 bp, Artificial Sequence
  Synthetic Oligonucleotide
gguguucaagauguccucgagauac

SEQ ID NO: 112 - DNA, 25 bp, Artificial Sequence
  Synthetic Oligonucleotide
guguucaagauguccucgagauact

SEQ ID NO: 113 - DNA, 25 bp, Artificial Sequence
  Synthetic Oligonucleotide
uguucaagauguccucgagauacta

SEQ ID NO: 114 - DNA, 25 bp, Artificial Sequence
  Synthetic Oligonucleotide
guucaagauguccucgagauacuaa

SEQ ID NO: 115 - DNA, 25 bp, Artificial Sequence
  Synthetic Oligonucleotide
uucaagauguccucgagauacuaaa

SEQ ID NO: 116 - DNA, 25 bp, Artificial Sequence
  Synthetic Oligonucleotide
ucaagauguccucgagauacuaaag

SEQ ID NO: 117 - DNA, 25 bp, Artificial Sequence
  Synthetic Oligonucleotide
uggccauggcucugagugggugcca

SEQ ID NO: 118 - DNA, 25 bp, Artificial Sequence
  Synthetic Oligonucleotide
ggccauggcucugagugggugccag

SEQ ID NO: 119 - DNA, 25 bp, Artificial Sequence
  Synthetic Oligonucleotide
gccauggcucugagugggugccaga

SEQ ID NO: 120 - DNA, 25 bp, Artificial Sequence
  Synthetic Oligonucleotide
ccauggcucugagugggugccagaa

SEQ ID NO: 121 - DNA, 25 bp, Artificial Sequence
  Synthetic Oligonucleotide
cauggcucugagugggugccagaat

SEQ ID NO: 122 - DNA, 25 bp, Artificial Sequence
  Synthetic Oligonucleotide
auggcucugagugggugccagaatg

SEQ ID NO: 123 - DNA, 25 bp, Artificial Sequence
  Synthetic Oligonucleotide
uggcucugagugggugccagaaugt

SEQ ID NO: 124 - DNA, 25 bp, Artificial Sequence
  Synthetic Oligonucleotide
ggcucugagugggugccagaaugtg

SEQ ID NO: 125 - DNA, 25 bp, Artificial Sequence
  Synthetic Oligonucleotide
gcucugagugggugccagaauguga

SEQ ID NO: 126 - DNA, 25 bp, Artificial Sequence
  Synthetic Oligonucleotide
cucugagugggugccagaaugugaa

SEQ ID NO: 127 - DNA, 25 bp, Artificial Sequence
  Synthetic Oligonucleotide
ucugagugggugccagaaugugaaa

SEQ ID NO: 128 - DNA, 25 bp, Artificial Sequence
  Synthetic Oligonucleotide
cugagugggugccagaaugugaaag

SEQ ID NO: 129 - DNA, 25 bp, Artificial Sequence
  Synthetic Oligonucleotide
ugagugggugccagaaugugaaagt

SEQ ID NO: 130 - DNA, 25 bp, Artificial Sequence
  Synthetic Oligonucleotide
gagugggugccagaaugugaaagtc

SEQ ID NO: 131 - DNA, 25 bp, Artificial Sequence
  Synthetic Oligonucleotide
agugggugccagaaugugaaaguca

SEQ ID NO: 132 - DNA, 25 bp, Artificial Sequence
  Synthetic Oligonucleotide
gugggugccagaaugugaaagucat

SEQ ID NO: 133 - DNA, 25 bp, Artificial Sequence
  Synthetic Oligonucleotide
ugggugccagaaugugaaagucatc

SEQ ID NO: 134 - DNA, 25 bp, Artificial Sequence
  Synthetic Oligonucleotide
gggugccagaaugugaaagucaucg

SEQ ID NO: 135 - DNA, 25 bp, Artificial Sequence
  Synthetic Oligonucleotide
ggugccagaaugugaaagucaucga

SEQ ID NO: 136 - DNA, 25 bp, Artificial Sequence
  Synthetic Oligonucleotide
gugccagaaugugaaagucaucgac

SEQ ID NO: 137 - DNA, 25 bp, Artificial Sequence
  Synthetic Oligonucleotide
ugccagaaugugaaagucaucgaca

SEQ ID NO: 138 - DNA, 25 bp, Artificial Sequence
  Synthetic Oligonucleotide
gccagaaugugaaagucaucgacaa

SEQ ID NO: 139 - DNA, 25 bp, Artificial Sequence
  Synthetic Oligonucleotide
ccagaaugugaaagucaucgacaag

SEQ ID NO: 140 - DNA, 25 bp, Artificial Sequence
  Synthetic Oligonucleotide
cagaaugugaaagucaucgacaaga

SEQ ID NO: 141 - DNA, 25 bp, Artificial Sequence
  Synthetic Oligonucleotide
agaaugugaaagucaucgacaagac

SEQ ID NO: 142 - DNA, 25 bp, Artificial Sequence
  Synthetic Oligonucleotide
gaaugugaaagucaucgacaagaca

SEQ ID NO: 143 - DNA, 25 bp, Artificial Sequence
  Synthetic Oligonucleotide
aaugugaaagucaucgacaagacat

SEQ ID NO: 144 - DNA, 25 bp, Artificial Sequence
  Synthetic Oligonucleotide
augugaaagucaucgacaagacatt

SEQ ID NO: 145 - DNA, 25 bp, Artificial Sequence
  Synthetic Oligonucleotide
ugugaaagucaucgacaagacautg

SEQ ID NO: 146 - DNA, 25 bp, Artificial Sequence
  Synthetic Oligonucleotide
gugaaagucaucgacaagacauugg

SEQ ID NO: 147 - DNA, 25 bp, Artificial Sequence
  Synthetic Oligonucleotide
ugaaagucaucgacaagacauuggt

SEQ ID NO: 148 - DNA, 25 bp, Artificial Sequence
  Synthetic Oligonucleotide
gaaagucaucgacaagacauuggtg

SEQ ID NO: 149 - DNA, 25 bp, Artificial Sequence
  Synthetic Oligonucleotide
aaagucaucgacaagacauugguga

SEQ ID NO: 150 - DNA, 25 bp, Artificial Sequence
  Synthetic Oligonucleotide
aagucaucgacaagacauuggugag

SEQ ID NO: 151 - DNA, 25 bp, Artificial Sequence
  Synthetic Oligonucleotide
agucaucgacaagacauuggugagg

SEQ ID NO: 152 - DNA, 25 bp, Artificial Sequence
  Synthetic Oligonucleotide
gucaucgacaagacauuggugagga

SEQ ID NO: 153 - DNA, 25 bp, Artificial Sequence
  Synthetic Oligonucleotide
ucaucgacaagacauuggugaggaa

SEQ ID NO: 154 - DNA, 25 bp, Artificial Sequence
  Synthetic Oligonucleotide
caucgacaagacauuggugaggaaa

SEQ ID NO: 155 - DNA, 25 bp, Artificial Sequence
  Synthetic Oligonucleotide
aucgacaagacauuggugaggaaaa

SEQ ID NO: 156 - DNA, 25 bp, Artificial Sequence
  Synthetic Oligonucleotide
ucgacaagacauuggugaggaaaaa

SEQ ID NO: 157 - DNA, 25 bp, Artificial Sequence
  Synthetic Oligonucleotide
cgacaagacauuggugaggaaaaat

SEQ ID NO: 158 - DNA, 25 bp, Artificial Sequence
  Synthetic Oligonucleotide
gacaagacauuggugaggaaaaatc

SEQ ID NO: 159 - DNA, 25 bp, Artificial Sequence
  Synthetic Oligonucleotide
acaagacauuggugaggaaaaaucc

SEQ ID NO: 160 - DNA, 25 bp, Artificial Sequence
  Synthetic Oligonucleotide
caagacauuggugaggaaaaaucct

SEQ ID NO: 161 - DNA, 25 bp, Artificial Sequence
  Synthetic Oligonucleotide
aagacauuggugaggaaaaaucctt

SEQ ID NO: 162 - DNA, 25 bp, Artificial Sequence
  Synthetic Oligonucleotide
agacauuggugaggaaaaauccutt

SEQ ID NO: 163 - DNA, 25 bp, Artificial Sequence
  Synthetic Oligonucleotide
gacauuggugaggaaaaauccuutg

SEQ ID NO: 164 - DNA, 25 bp, Artificial Sequence
  Synthetic Oligonucleotide
acauuggugaggaaaaauccuuugg

SEQ ID NO: 165 - DNA, 25 bp, Artificial Sequence
  Synthetic Oligonucleotide
cauuggugaggaaaaauccuuuggc

SEQ ID NO: 166 - DNA, 25 bp, Artificial Sequence
  Synthetic Oligonucleotide
auuggugaggaaaaauccuuuggcc

SEQ ID NO: 167 - DNA, 25 bp, Artificial Sequence
  Synthetic Oligonucleotide
uuggugaggaaaaauccuuuggccg

SEQ ID NO: 168 - DNA, 25 bp, Artificial Sequence
  Synthetic Oligonucleotide
uggugaggaaaaauccuuuggccgt

SEQ ID NO: 169 - DNA, 25 bp, Artificial Sequence
  Synthetic Oligonucleotide
ggugaggaaaaauccuuuggccgtt

SEQ ID NO: 170 - DNA, 25 bp, Artificial Sequence
  Synthetic Oligonucleotide
gugaggaaaaauccuuuggccgutt

SEQ ID NO: 171 - DNA, 25 bp, Artificial Sequence
  Synthetic Oligonucleotide
ugaggaaaaauccuuuggccguutc

SEQ ID NO: 172 - DNA, 25 bp, Artificial Sequence
  Synthetic Oligonucleotide
guuuccaagaucugacagugcacaa

SEQ ID NO: 173 - DNA, 25 bp, Artificial Sequence
  Synthetic Oligonucleotide
uuuccaagaucugacagugcacaat

SEQ ID NO: 174 - DNA, 25 bp, Artificial Sequence
  Synthetic Oligonucleotide
uuccaagaucugacagugcacaata

SEQ ID NO: 175 - DNA, 25 bp, Artificial Sequence
  Synthetic Oligonucleotide
uccaagaucugacagugcacaauat

SEQ ID NO: 176 - DNA, 25 bp, Artificial Sequence
  Synthetic Oligonucleotide
ccaagaucugacagugcacaauatt

SEQ ID NO: 177 - DNA, 25 bp, Artificial Sequence
  Synthetic Oligonucleotide
caagaucugacagugcacaauautt

SEQ ID NO: 178 - DNA, 25 bp, Artificial Sequence
  Synthetic Oligonucleotide
aagaucugacagugcacaauauutt

SEQ ID NO: 179 - DNA, 25 bp, Artificial Sequence
  Synthetic Oligonucleotide
agaucugacagugcacaauauuutc

SEQ ID NO: 180 - DNA, 25 bp, Artificial Sequence
  Synthetic Oligonucleotide
gaucugacagugcacaauauuuucc

SEQ ID NO: 181 - DNA, 25 bp, Artificial Sequence
  Synthetic Oligonucleotide
aucugacagugcacaauauuuuccc

SEQ ID NO: 182 - DNA, 25 bp, Artificial Sequence
  Synthetic Oligonucleotide
ucugacagugcacaauauuuuccca

SEQ ID NO: 183 - DNA, 25 bp, Artificial Sequence
  Synthetic Oligonucleotide
cugacagugcacaauauuuucccat

SEQ ID NO: 184 - DNA, 25 bp, Artificial Sequence
  Synthetic Oligonucleotide
ugacagugcacaauauuuucccatc

SEQ ID NO: 185 - DNA, 25 bp, Artificial Sequence
  Synthetic Oligonucleotide
gacagugcacaauauuuucccauct

SEQ ID NO: 186 - DNA, 25 bp, Artificial Sequence
  Synthetic Oligonucleotide
acagugcacaauauuuucccauctg

SEQ ID NO: 187 - DNA, 25 bp, Artificial Sequence
  Synthetic Oligonucleotide
cagugcacaauauuuucccaucugt

SEQ ID NO: 188 - DNA, 25 bp, Artificial Sequence
  Synthetic Oligonucleotide
agugcacaauauuuucccaucugta

SEQ ID NO: 189 - DNA, 25 bp, Artificial Sequence
  Synthetic Oligonucleotide
gugcacaauauuuucccaucuguat

SEQ ID NO: 190 - DNA, 25 bp, Artificial Sequence
  Synthetic Oligonucleotide
ugcacaauauuuucccaucuguatt

SEQ ID NO: 191 - DNA, 25 bp, Artificial Sequence
  Synthetic Oligonucleotide
gcacaauauuuucccaucuguauta

SEQ ID NO: 192 - DNA, 25 bp, Artificial Sequence
  Synthetic Oligonucleotide
cacaauauuuucccaucuguauuat

SEQ ID NO: 193 - DNA, 25 bp, Artificial Sequence
  Synthetic Oligonucleotide
acaauauuuucccaucuguauuatt

SEQ ID NO: 194 - DNA, 25 bp, Artificial Sequence
  Synthetic Oligonucleotide
caauauuuucccaucuguauuautt

SEQ ID NO: 195 - DNA, 25 bp, Artificial Sequence
  Synthetic Oligonucleotide
aauauuuucccaucuguauuauutt

SEQ ID NO: 196 - DNA, 25 bp, Artificial Sequence
  Synthetic Oligonucleotide
auauuuucccaucuguauuauuutt

SEQ ID NO: 197 - DNA, 25 bp, Artificial Sequence
  Synthetic Oligonucleotide
uauuuucccaucuguauuauuuutt

SEQ ID NO: 198 - DNA, 25 bp, Artificial Sequence
  Synthetic Oligonucleotide
auuuucccaucuguauuauuuuutt

SEQ ID NO: 199 - DNA, 25 bp, Artificial Sequence
  Synthetic Oligonucleotide
uuuuucagcauguauuacuugacaa

SEQ ID NO: 200 - DNA, 25 bp, Artificial Sequence
  Synthetic Oligonucleotide
uuuucagcauguauuacuugacaaa

SEQ ID NO: 201 - DNA, 25 bp, Artificial Sequence
  Synthetic Oligonucleotide
uuucagcauguauuacuugacaaag

SEQ ID NO: 202 - DNA, 25 bp, Artificial Sequence
  Synthetic Oligonucleotide
uucagcauguauuacuugacaaaga

SEQ ID NO: 203 - DNA, 25 bp, Artificial Sequence
  Synthetic Oligonucleotide
ucagcauguauuacuugacaaagag

SEQ ID NO: 204 - DNA, 25 bp, Artificial Sequence
  Synthetic Oligonucleotide
cagcauguauuacuugacaaagaga

SEQ ID NO: 205 - DNA, 25 bp, Artificial Sequence
  Synthetic Oligonucleotide
agcauguauuacuugacaaagagac

SEQ ID NO: 206 - DNA, 25 bp, Artificial Sequence
  Synthetic Oligonucleotide
gcauguauuacuugacaaagagaca

SEQ ID NO: 207 - DNA, 25 bp, Artificial Sequence
  Synthetic Oligonucleotide
cauguauuacuugacaaagagacac

SEQ ID NO: 208 - DNA, 25 bp, Artificial Sequence
  Synthetic Oligonucleotide
uauuacuugacaaagagacacugtg

SEQ ID NO: 209 - DNA, 25 bp, Artificial Sequence
  Synthetic Oligonucleotide
auuacuugacaaagagacacugugc

SEQ ID NO: 210 - DNA, 25 bp, Artificial Sequence
  Synthetic Oligonucleotide
uuacuugacaaagagacacugugca

SEQ ID NO: 211 - DNA, 25 bp, Artificial Sequence
  Synthetic Oligonucleotide
uacuugacaaagagacacugugcag

SEQ ID NO: 212 - DNA, 25 bp, Artificial Sequence
  Synthetic Oligonucleotide
acuugacaaagagacacugugcaga

SEQ ID NO: 213 - DNA, 25 bp, Artificial Sequence
  Synthetic Oligonucleotide
cuugacaaagagacacugugcagag

SEQ ID NO: 214 - DNA, 25 bp, Artificial Sequence
  Synthetic Oligonucleotide
uugacaaagagacacugugcagagg

SEQ ID NO: 215 - DNA, 25 bp, Artificial Sequence
  Synthetic Oligonucleotide
ugacaaagagacacugugcagaggg

SEQ ID NO: 216 - DNA, 25 bp, Artificial Sequence
  Synthetic Oligonucleotide
gacaaagagacacugugcagagggt

SEQ ID NO: 217 - DNA, 25 bp, Artificial Sequence
  Synthetic Oligonucleotide
acaaagagacacugugcagagggtg

SEQ ID NO: 218 - DNA, 25 bp, Artificial Sequence
  Synthetic Oligonucleotide
caaagagacacugugcagaggguga

SEQ ID NO: 219 - DNA, 25 bp, Artificial Sequence
  Synthetic Oligonucleotide
aaagagacacugugcagagggugac

SEQ ID NO: 220 - DNA, 25 bp, Artificial Sequence
  Synthetic Oligonucleotide
aagagacacugugcagagggugacc

SEQ ID NO: 221 - DNA, 25 bp, Artificial Sequence
  Synthetic Oligonucleotide
agagacacugugcagagggugacca

SEQ ID NO: 222 - DNA, 25 bp, Artificial Sequence
  Synthetic Oligonucleotide
gagacacugugcagagggugaccac

SEQ ID NO: 223 - DNA, 25 bp, Artificial Sequence
  Synthetic Oligonucleotide
agacacugugcagagggugaccaca

SEQ ID NO: 224 - DNA, 25 bp, Artificial Sequence
  Synthetic Oligonucleotide
gacacugugcagagggugaccacag

SEQ ID NO: 225 - DNA, 25 bp, Artificial Sequence
  Synthetic Oligonucleotide
acacugugcagagggugaccacagt

SEQ ID NO: 226 - DNA, 25 bp, Artificial Sequence
  Synthetic Oligonucleotide
cacugugcagagggugaccacagtc

SEQ ID NO: 227 - DNA, 25 bp, Artificial Sequence
  Synthetic Oligonucleotide
acugugcagagggugaccacaguct

SEQ ID NO: 228 - DNA, 25 bp, Artificial Sequence
  Synthetic Oligonucleotide
cugugcagagggugaccacaguctg

SEQ ID NO: 229 - DNA, 25 bp, Artificial Sequence
  Synthetic Oligonucleotide
ugugcagagggugaccacagucugt

SEQ ID NO: 230 - DNA, 25 bp, Artificial Sequence
  Synthetic Oligonucleotide
gugcagagggugaccacagucugta

SEQ ID NO: 231 - DNA, 25 bp, Artificial Sequence
  Synthetic Oligonucleotide
gucuguaauuccccacuucaauaca

SEQ ID NO: 232 - DNA, 25 bp, Artificial Sequence
  Synthetic Oligonucleotide
ucuguaauuccccacuucaauacaa

SEQ ID NO: 233 - DNA, 25 bp, Artificial Sequence
  Synthetic Oligonucleotide
cuguaauuccccacuucaauacaaa

SEQ ID NO: 234 - DNA, 25 bp, Artificial Sequence
  Synthetic Oligonucleotide
uguaauuccccacuucaauacaaag

SEQ ID NO: 235 - DNA, 25 bp, Artificial Sequence
  Synthetic Oligonucleotide
auacaaagggugucguucuuuucca

SEQ ID NO: 236 - DNA, 25 bp, Artificial Sequence
  Synthetic Oligonucleotide
uacaaagggugucguucuuuuccaa

SEQ ID NO: 237 - DNA, 25 bp, Artificial Sequence
  Synthetic Oligonucleotide
acaaagggugucguucuuuuccaac

SEQ ID NO: 238 - DNA, 25 bp, Artificial Sequence
  Synthetic Oligonucleotide
caaagggugucguucuuuuccaaca

SEQ ID NO: 239 - DNA, 25 bp, Artificial Sequence
  Synthetic Oligonucleotide
aaagggugucguucuuuuccaacaa

SEQ ID NO: 240 - DNA, 25 bp, Artificial Sequence
  Synthetic Oligonucleotide
aagggugucguucuuuuccaacaaa

SEQ ID NO: 241 - DNA, 25 bp, Artificial Sequence
  Synthetic Oligonucleotide
agggugucguucuuuuccaacaaaa

SEQ ID NO: 242 - DNA, 25 bp, Artificial Sequence
  Synthetic Oligonucleotide
gggugucguucuuuuccaacaaaat

SEQ ID NO: 243 - DNA, 25 bp, Artificial Sequence
  Synthetic Oligonucleotide
ggugucguucuuuuccaacaaaata

SEQ ID NO: 244 - DNA, 25 bp, Artificial Sequence
  Synthetic Oligonucleotide
gugucguucuuuuccaacaaaauag

SEQ ID NO: 245 - DNA, 25 bp, Artificial Sequence
  Synthetic Oligonucleotide
ugucguucuuuuccaacaaaauagc

SEQ ID NO: 246 - DNA, 25 bp, Artificial Sequence
  Synthetic Oligonucleotide
gucguucuuuuccaacaaaauagca

SEQ ID NO: 247 - DNA, 25 bp, Artificial Sequence
  Synthetic Oligonucleotide
ucguucuuuuccaacaaaauagcaa

SEQ ID NO: 248 - DNA, 25 bp, Artificial Sequence
  Synthetic Oligonucleotide
cguucuuuuccaacaaaauagcaat

SEQ ID NO: 249 - DNA, 25 bp, Artificial Sequence
  Synthetic Oligonucleotide
guucuuuuccaacaaaauagcaatc

SEQ ID NO: 250 - DNA, 25 bp, Artificial Sequence
  Synthetic Oligonucleotide
uucuuuuccaacaaaauagcaaucc

SEQ ID NO: 251 - DNA, 25 bp, Artificial Sequence
  Synthetic Oligonucleotide
ucuuuuccaacaaaauagcaauccc

SEQ ID NO: 252 - DNA, 25 bp, Artificial Sequence
  Synthetic Oligonucleotide
caacaaaauagcaaucccuuuuatt

SEQ ID NO: 253 - DNA, 25 bp, Artificial Sequence
  Synthetic Oligonucleotide
aacaaaauagcaaucccuuuuautt

SEQ ID NO: 254 - DNA, 25 bp, Artificial Sequence
  Synthetic Oligonucleotide
acaaaauagcaaucccuuuuauutc

SEQ ID NO: 255 - DNA, 25 bp, Artificial Sequence
  Synthetic Oligonucleotide
caaaauagcaaucccuuuuauuuca

SEQ ID NO: 256 - DNA, 25 bp, Artificial Sequence
  Synthetic Oligonucleotide
aaaauagcaaucccuuuuauuucat

SEQ ID NO: 257 - DNA, 25 bp, Artificial Sequence
  Synthetic Oligonucleotide
uucauugcuuuugacuuuucaaugg

SEQ ID NO: 258 - DNA, 25 bp, Artificial Sequence
  Synthetic Oligonucleotide
ucauugcuuuugacuuuucaauggg

SEQ ID NO: 259 - DNA, 25 bp, Artificial Sequence
  Synthetic Oligonucleotide
cauugcuuuugacuuuucaaugggt

SEQ ID NO: 260 - DNA, 25 bp, Artificial Sequence
  Synthetic Oligonucleotide
auugcuuuugacuuuucaaugggtg

SEQ ID NO: 261 - DNA, 25 bp, Artificial Sequence
  Synthetic Oligonucleotide
uugcuuuugacuuuucaaugggugt

SEQ ID NO: 262 - DNA, 25 bp, Artificial Sequence
  Synthetic Oligonucleotide
ugcuuuugacuuuucaaugggugtc

SEQ ID NO: 263 - DNA, 25 bp, Artificial Sequence
  Synthetic Oligonucleotide
gcuuuugacuuuucaaugggugucc

SEQ ID NO: 264 - DNA, 25 bp, Artificial Sequence
  Synthetic Oligonucleotide
cuuuugacuuuucaaugggugucct

SEQ ID NO: 265 - DNA, 25 bp, Artificial Sequence
  Synthetic Oligonucleotide
uuuugacuuuucaauggguguccta

SEQ ID NO: 266 - DNA, 25 bp, Artificial Sequence
  Synthetic Oligonucleotide
uuugacuuuucaauggguguccuag

SEQ ID NO: 267 - DNA, 25 bp, Artificial Sequence
  Synthetic Oligonucleotide
uugacuuuucaauggguguccuagg

SEQ ID NO: 268 - DNA, 25 bp, Artificial Sequence
  Synthetic Oligonucleotide
ugacuuuucaauggguguccuagga

SEQ ID NO: 269 - DNA, 25 bp, Artificial Sequence
  Synthetic Oligonucleotide
gacuuuucaauggguguccuaggaa

SEQ ID NO: 270 - DNA, 25 bp, Artificial Sequence
  Synthetic Oligonucleotide
acuuuucaauggguguccuaggaac

SEQ ID NO: 271 - DNA, 25 bp, Artificial Sequence
  Synthetic Oligonucleotide
cuuuucaauggguguccuaggaacc

SEQ ID NO: 272 - DNA, 25 bp, Artificial Sequence
  Synthetic Oligonucleotide
uuuucaauggguguccuaggaacct

SEQ ID NO: 273 - DNA, 25 bp, Artificial Sequence
  Synthetic Oligonucleotide
uuucaauggguguccuaggaacctt

SEQ ID NO: 274 - DNA, 25 bp, Artificial Sequence
  Synthetic Oligonucleotide
uucaauggguguccuaggaaccutt

SEQ ID NO: 275 - DNA, 25 bp, Artificial Sequence
  Synthetic Oligonucleotide
ucaauggguguccuaggaaccuutt

SEQ ID NO: 276 - DNA, 25 bp, Artificial Sequence
  Synthetic Oligonucleotide
caauggguguccuaggaaccuuuta

SEQ ID NO: 277 - DNA, 25 bp, Artificial Sequence
  Synthetic Oligonucleotide
aauggguguccuaggaaccuuuuag

SEQ ID NO: 278 - DNA, 25 bp, Artificial Sequence
  Synthetic Oligonucleotide
auggguguccuaggaaccuuuuaga

SEQ ID NO: 279 - DNA, 25 bp, Artificial Sequence
  Synthetic Oligonucleotide
uggguguccuaggaaccuuuuagaa

SEQ ID NO: 280 - DNA, 25 bp, Artificial Sequence
  Synthetic Oligonucleotide
aaauggacuuucauccuggaaauat

SEQ ID NO: 281 - DNA, 25 bp, Artificial Sequence
  Synthetic Oligonucleotide
aauggacuuucauccuggaaauata

SEQ ID NO: 282 - DNA, 25 bp, Artificial Sequence
  Synthetic Oligonucleotide
auggacuuucauccuggaaauauat

SEQ ID NO: 283 - DNA, 25 bp, Artificial Sequence
  Synthetic Oligonucleotide
uggacuuucauccuggaaauauatt

SEQ ID NO: 284 - DNA, 25 bp, Artificial Sequence
  Synthetic Oligonucleotide
ggacuuucauccuggaaauauauta

SEQ ID NO: 285 - DNA, 25 bp, Artificial Sequence
  Synthetic Oligonucleotide
gacuuucauccuggaaauauauuaa

SEQ ID NO: 286 - DNA, 25 bp, Artificial Sequence
  Synthetic Oligonucleotide
acuuucauccuggaaauauauuaac

SEQ ID NO: 287 - DNA, 25 bp, Artificial Sequence
  Synthetic Oligonucleotide
cuuucauccuggaaauauauuaact

SEQ ID NO: 288 - DNA, 25 bp, Artificial Sequence
  Synthetic Oligonucleotide
uuucauccuggaaauauauuaactg

SEQ ID NO: 289 - DNA, 25 bp, Artificial Sequence
  Synthetic Oligonucleotide
uucauccuggaaauauauuaacugt

SEQ ID NO: 290 - DNA, 25 bp, Artificial Sequence
  Synthetic Oligonucleotide
ucauccuggaaauauauuaacugtt

SEQ ID NO: 291 - DNA, 25 bp, Artificial Sequence
  Synthetic Oligonucleotide
cauccuggaaauauauuaacuguta

SEQ ID NO: 292 - DNA, 25 bp, Artificial Sequence
  Synthetic Oligonucleotide
auccuggaaauauauuaacuguuaa

SEQ ID NO: 293 - DNA, 25 bp, Artificial Sequence
  Synthetic Oligonucleotide
uccuggaaauauauuaacuguuaaa

SEQ ID NO: 294 - DNA, 25 bp, Artificial Sequence
  Synthetic Oligonucleotide
ccuggaaauauauuaacuguuaaaa

SEQ ID NO: 295 - DNA, 25 bp, Artificial Sequence
  Synthetic Oligonucleotide
cuggaaauauauuaacuguuaaaaa

SEQ ID NO: 296 - DNA, 25 bp, Artificial Sequence
  Synthetic Oligonucleotide
uggaaauauauuaacuguuaaaaag

SEQ ID NO: 297 - DNA, 25 bp, Artificial Sequence
  Synthetic Oligonucleotide
ggaaauauauuaacuguuaaaaaga

SEQ ID NO: 298 - DNA, 25 bp, Artificial Sequence
  Synthetic Oligonucleotide
gaaauauauuaacuguuaaaaagaa

SEQ ID NO: 299 - DNA, 25 bp, Artificial Sequence
  Synthetic Oligonucleotide
aaauauauuaacuguuaaaaagaaa

SEQ ID NO: 300 - DNA, 25 bp, Artificial Sequence
  Synthetic Oligonucleotide
aauauauuaacuguuaaaaagaaaa

SEQ ID NO: 301 - DNA, 25 bp, Artificial Sequence
  Synthetic Oligonucleotide
auauauuaacuguuaaaaagaaaac

SEQ ID NO: 302 - DNA, 25 bp, Artificial Sequence
  Synthetic Oligonucleotide
uauauuaacuguuaaaaagaaaaca

SEQ ID NO: 303 - DNA, 25 bp, Artificial Sequence
  Synthetic Oligonucleotide
auauuaacuguuaaaaagaaaacat

SEQ ID NO: 304 - DNA, 25 bp, Artificial Sequence
  Synthetic Oligonucleotide
uauuaacuguuaaaaagaaaacatt

SEQ ID NO: 305 - DNA, 25 bp, Artificial Sequence
  Synthetic Oligonucleotide
auuaacuguuaaaaagaaaacautg

SEQ ID NO: 306 - DNA, 25 bp, Artificial Sequence
  Synthetic Oligonucleotide
uuaacuguuaaaaagaaaacauuga

SEQ ID NO: 307 - DNA, 25 bp, Artificial Sequence
  Synthetic Oligonucleotide
uaacuguuaaaaagaaaacauugaa

SEQ ID NO: 308 - DNA, 25 bp, Artificial Sequence
  Synthetic Oligonucleotide
aacuguuaaaaagaaaacauugaaa

SEQ ID NO: 309 - DNA, 25 bp, Artificial Sequence
  Synthetic Oligonucleotide
acuguuaaaaagaaaacauugaaaa

SEQ ID NO: 310 - DNA, 25 bp, Artificial Sequence
  Synthetic Oligonucleotide
cuguuaaaaagaaaacauugaaaat

SEQ ID NO: 311 - DNA, 25 bp, Artificial Sequence
  Synthetic Oligonucleotide
uguuaaaaagaaaacauugaaaatg

SEQ ID NO: 312 - DNA, 25 bp, Artificial Sequence
  Synthetic Oligonucleotide
guuaaaaagaaaacauugaaaaugt

SEQ ID NO: 313 - DNA, 25 bp, Artificial Sequence
  Synthetic Oligonucleotide
uuaaaaagaaaacauugaaaaugtg

SEQ ID NO: 314 - DNA, 25 bp, Artificial Sequence
  Synthetic Oligonucleotide
caacgucauccccuggcaggcuaaa

SEQ ID NO: 315 - DNA, 25 bp, Artificial Sequence
  Synthetic Oligonucleotide
aacgucauccccuggcaggcuaaag

SEQ ID NO: 316 - DNA, 25 bp, Artificial Sequence
  Synthetic Oligonucleotide
acgucauccccuggcaggcuaaagt

SEQ ID NO: 317 - DNA, 25 bp, Artificial Sequence
  Synthetic Oligonucleotide
cgucauccccuggcaggcuaaagtg

SEQ ID NO: 318 - DNA, 25 bp, Artificial Sequence
  Synthetic Oligonucleotide
gucauccccuggcaggcuaaagugc

SEQ ID NO: 319 - DNA, 25 bp, Artificial Sequence
  Synthetic Oligonucleotide
ucauccccuggcaggcuaaagugct

SEQ ID NO: 320 - DNA, 25 bp, Artificial Sequence
  Synthetic Oligonucleotide
cauccccuggcaggcuaaagugctg

SEQ ID NO: 321 - DNA, 25 bp, Artificial Sequence
  Synthetic Oligonucleotide
auccccuggcaggcuaaagugcugt

SEQ ID NO: 322 - DNA, 25 bp, Artificial Sequence
  Synthetic Oligonucleotide
uccccuggcaggcuaaagugcugta

SEQ ID NO: 323 - DNA, 25 bp, Artificial Sequence
  Synthetic Oligonucleotide
ccccuggcaggcuaaagugcuguat

SEQ ID NO: 324 - DNA, 25 bp, Artificial Sequence
  Synthetic Oligonucleotide
cccuggcaggcuaaagugcuguatc

SEQ ID NO: 325 - DNA, 25 bp, Artificial Sequence
  Synthetic Oligonucleotide
ccuggcaggcuaaagugcuguaucc

SEQ ID NO: 326 - DNA, 25 bp, Artificial Sequence
  Synthetic Oligonucleotide
cuggcaggcuaaagugcuguaucct

SEQ ID NO: 327 - DNA, 25 bp, Artificial Sequence
  Synthetic Oligonucleotide
guagcaaacacuaaggugaaaagat

SEQ ID NO: 328 - DNA, 25 bp, Artificial Sequence
  Synthetic Oligonucleotide
uagcaaacacuaaggugaaaagata

SEQ ID NO: 329 - DNA, 25 bp, Artificial Sequence
  Synthetic Oligonucleotide
agcaaacacuaaggugaaaagauaa

SEQ ID NO: 330 - DNA, 25 bp, Artificial Sequence
  Synthetic Oligonucleotide
gcaaacacuaaggugaaaagauaat

SEQ ID NO: 331 - DNA, 25 bp, Artificial Sequence
  Synthetic Oligonucleotide
aaacacuaaggugaaaagauaauga

SEQ ID NO: 332 - DNA, 25 bp, Artificial Sequence
  Synthetic Oligonucleotide
aacacuaaggugaaaagauaaugat

SEQ ID NO: 333 - DNA, 25 bp, Artificial Sequence
  Synthetic Oligonucleotide
cuaaggugaaaagauaaugaucuca

SEQ ID NO: 334 - DNA, 25 bp, Artificial Sequence
  Synthetic Oligonucleotide
uaaggugaaaagauaaugaucucat

SEQ ID NO: 335 - DNA, 25 bp, Artificial Sequence
  Synthetic Oligonucleotide
aaggugaaaagauaaugaucucatt

SEQ ID NO: 336 - DNA, 25 bp, Artificial Sequence
  Synthetic Oligonucleotide
aggugaaaagauaaugaucucautg

SEQ ID NO: 337 - DNA, 25 bp, Artificial Sequence
  Synthetic Oligonucleotide
ggugaaaagauaaugaucucauugt

SEQ ID NO: 338 - DNA, 25 bp, Artificial Sequence
  Synthetic Oligonucleotide
gugaaaagauaaugaucucauugtt

SEQ ID NO: 339 - DNA, 25 bp, Artificial Sequence
  Synthetic Oligonucleotide
ugaaaagauaaugaucucauugutt

SEQ ID NO: 340 - DNA, 25 bp, Artificial Sequence
  Synthetic Oligonucleotide
gaaaagauaaugaucucauuguuta

SEQ ID NO: 341 - DNA, 25 bp, Artificial Sequence
  Synthetic Oligonucleotide
aaaagauaaugaucucauuguuuat

SEQ ID NO: 342 - DNA, 25 bp, Artificial Sequence
  Synthetic Oligonucleotide
aaagauaaugaucucauuguuuatt

SEQ ID NO: 343 - DNA, 25 bp, Artificial Sequence
  Synthetic Oligonucleotide
aagauaaugaucucauuguuuauta

SEQ ID NO: 344 - DNA, 25 bp, Artificial Sequence
  Synthetic Oligonucleotide
agauaaugaucucauuguuuauuaa

SEQ ID NO: 345 - DNA, 25 bp, Artificial Sequence
  Synthetic Oligonucleotide
gauaaugaucucauuguuuauuaac

SEQ ID NO: 346 - DNA, 25 bp, Artificial Sequence
  Synthetic Oligonucleotide
auaaugaucucauuguuuauuaacc

SEQ ID NO: 347 - DNA, 25 bp, Artificial Sequence
  Synthetic Oligonucleotide
uaaugaucucauuguuuauuaacct

SEQ ID NO: 348 - DNA, 25 bp, Artificial Sequence
  Synthetic Oligonucleotide
aaugaucucauuguuuauuaacctg

SEQ ID NO: 349 - DNA, 25 bp, Artificial Sequence
  Synthetic Oligonucleotide
augaucucauuguuuauuaaccugt

SEQ ID NO: 350 - DNA, 25 bp, Artificial Sequence
  Synthetic Oligonucleotide
ugaucucauuguuuauuaaccugta

SEQ ID NO: 351 - DNA, 25 bp, Artificial Sequence
  Synthetic Oligonucleotide
gaucucauuguuuauuaaccuguat

SEQ ID NO: 352 - DNA, 25 bp, Artificial Sequence
  Synthetic Oligonucleotide
aucucauuguuuauuaaccuguatt

SEQ ID NO: 353 - DNA, 25 bp, Artificial Sequence
  Synthetic Oligonucleotide
ucucauuguuuauuaaccuguautc

SEQ ID NO: 354 - DNA, 25 bp, Artificial Sequence
  Synthetic Oligonucleotide
cucauuguuuauuaaccuguauuct

SEQ ID NO: 355 - DNA, 25 bp, Artificial Sequence
  Synthetic Oligonucleotide
ucauuguuuauuaaccuguauuctg

SEQ ID NO: 356 - DNA, 25 bp, Artificial Sequence
  Synthetic Oligonucleotide
cauuguuuauuaaccuguauucugt

SEQ ID NO: 357 - DNA, 25 bp, Artificial Sequence
  Synthetic Oligonucleotide
auuguuuauuaaccuguauucugtt

SEQ ID NO: 358 - DNA, 25 bp, Artificial Sequence
  Synthetic Oligonucleotide
guuuauuaaccuguauucuguuuac

SEQ ID NO: 359 - DNA, 25 bp, Artificial Sequence
  Synthetic Oligonucleotide
uuuauuaaccuguauucuguuuaca

SEQ ID NO: 360 - DNA, 25 bp, Artificial Sequence
  Synthetic Oligonucleotide
auuaaccuguauucuguuuacaugt

SEQ ID NO: 361 - DNA, 25 bp, Artificial Sequence
  Synthetic Oligonucleotide
uuaaccuguauucuguuuacaugtc

SEQ ID NO: 362 - DNA, 25 bp, Artificial Sequence
  Synthetic Oligonucleotide
uuaaaacagugguucuuaaauugta

SEQ ID NO: 363 - DNA, 25 bp, Artificial Sequence
  Synthetic Oligonucleotide
uaaaacagugguucuuaaauuguaa

SEQ ID NO: 364 - DNA, 25 bp, Artificial Sequence
  Synthetic Oligonucleotide
aaaacagugguucuuaaauuguaag

SEQ ID NO: 365 - DNA, 25 bp, Artificial Sequence
  Synthetic Oligonucleotide
aaacagugguucuuaaauuguaagc

SEQ ID NO: 366 - DNA, 25 bp, Artificial Sequence
  Synthetic Oligonucleotide
aacagugguucuuaaauuguaagct

SEQ ID NO: 367 - DNA, 25 bp, Artificial Sequence
  Synthetic Oligonucleotide
acagugguucuuaaauuguaagctc

SEQ ID NO: 368 - DNA, 25 bp, Artificial Sequence
  Synthetic Oligonucleotide
cagugguucuuaaauuguaagcuca

SEQ ID NO: 369 - DNA, 25 bp, Artificial Sequence
  Synthetic Oligonucleotide
guucuuaaauuguaagcucaggutc

SEQ ID NO: 370 - DNA, 25 bp, Artificial Sequence
  Synthetic Oligonucleotide
cuuaaauuguaagcucagguucaaa

SEQ ID NO: 371 - DNA, 25 bp, Artificial Sequence
  Synthetic Oligonucleotide
uuaaauuguaagcucagguucaaag

SEQ ID NO: 372 - DNA, 25 bp, Artificial Sequence
  Synthetic Oligonucleotide
aaauuguaagcucagguucaaagtg

SEQ ID NO: 373 - DNA, 25 bp, Artificial Sequence
  Synthetic Oligonucleotide
aauuguaagcucagguucaaagugt

SEQ ID NO: 374 - DNA, 25 bp, Artificial Sequence
  Synthetic Oligonucleotide
auuguaagcucagguucaaagugtt

SEQ ID NO: 375 - DNA, 25 bp, Artificial Sequence
  Synthetic Oligonucleotide
ggugauacuucuuugaauguagatt

SEQ ID NO: 376 - DNA, 25 bp, Artificial Sequence
  Synthetic Oligonucleotide
aucacaucuuuagugucugaauata

SEQ ID NO: 377 - DNA, 25 bp, Artificial Sequence
  Synthetic Oligonucleotide
uagugucugaauauauccaaaugtt

SEQ ID NO: 378 - DNA, 25 bp, Artificial Sequence
  Synthetic Oligonucleotide
agugucugaauauauccaaaugutt

SEQ ID NO: 379 - DNA, 25 bp, Artificial Sequence
  Synthetic Oligonucleotide
gugucugaauauauccaaauguutt

SEQ ID NO: 380 - DNA, 25 bp, Artificial Sequence
  Synthetic Oligonucleotide
gucugaauauauccaaauguuuuag

SEQ ID NO: 381 - DNA, 25 bp, Artificial Sequence
  Synthetic Oligonucleotide
ucugaauauauccaaauguuuuagg

SEQ ID NO: 382 - DNA, 25 bp, Artificial Sequence
  Synthetic Oligonucleotide
cugaauauauccaaauguuuuagga

SEQ ID NO: 383 - DNA, 25 bp, Artificial Sequence
  Synthetic Oligonucleotide
ugaauauauccaaauguuuuaggat

SEQ ID NO: 384 - DNA, 25 bp, Artificial Sequence
  Synthetic Oligonucleotide
gaauauauccaaauguuuuaggatg

SEQ ID NO: 385 - RNA, 27 nt, Artificial Sequence
  Synthetic Oligonucleotide
ucauaaucauugauacaaauuagccgg

SEQ ID NO: 386 - RNA, 27 nt, Artificial Sequence
  Synthetic Oligonucleotide
uucauaaucauugauacaaauuagccg

SEQ ID NO: 387 - RNA, 27 nt, Artificial Sequence
  Synthetic Oligonucleotide
guucauaaucauugauacaaauuagcc

SEQ ID NO: 388 - RNA, 27 nt, Artificial Sequence
  Synthetic Oligonucleotide
uguucauaaucauugauacaaauuagc

SEQ ID NO: 389 - RNA, 27 nt, Artificial Sequence
  Synthetic Oligonucleotide
uuguucauaaucauugauacaaauuag

SEQ ID NO: 390 - RNA, 27 nt, Artificial Sequence
  Synthetic Oligonucleotide
guuguucauaaucauugauacaaauua

SEQ ID NO: 391 - RNA, 27 nt, Artificial Sequence
  Synthetic Oligonucleotide
uguuguucauaaucauugauacaaauu

SEQ ID NO: 392 - RNA, 27 nt, Artificial Sequence
  Synthetic Oligonucleotide
auguuguucauaaucauugauacaaau

SEQ ID NO: 393 - RNA, 27 nt, Artificial Sequence
  Synthetic Oligonucleotide
cauguuguucauaaucauugauacaaa

SEQ ID NO: 394 - RNA, 27 nt, Artificial Sequence
  Synthetic Oligonucleotide
gcauguuguucauaaucauugauacaa

SEQ ID NO: 395 - RNA, 27 nt, Artificial Sequence
  Synthetic Oligonucleotide
uagcauguuguucauaaucauugauac

SEQ ID NO: 396 - RNA, 27 nt, Artificial Sequence
  Synthetic Oligonucleotide
uuagcauguuguucauaaucauugaua

SEQ ID NO: 397 - RNA, 27 nt, Artificial Sequence
  Synthetic Oligonucleotide
uuuagcauguuguucauaaucauugau

SEQ ID NO: 398 - RNA, 27 nt, Artificial Sequence
  Synthetic Oligonucleotide
auuuagcauguuguucauaaucauuga

SEQ ID NO: 399 - RNA, 27 nt, Artificial Sequence
  Synthetic Oligonucleotide
gauuuagcauguuguucauaaucauug

SEQ ID NO: 400 - RNA, 27 nt, Artificial Sequence
  Synthetic Oligonucleotide
ugauuuagcauguuguucauaaucauu

SEQ ID NO: 401 - RNA, 27 nt, Artificial Sequence
  Synthetic Oligonucleotide
cugauuuagcauguuguucauaaucau

SEQ ID NO: 402 - RNA, 27 nt, Artificial Sequence
  Synthetic Oligonucleotide
acugauuuagcauguuguucauaauca

SEQ ID NO: 403 - RNA, 27 nt, Artificial Sequence
  Synthetic Oligonucleotide
aguacugauuuagcauguuguucauaa

SEQ ID NO: 404 - RNA, 27 nt, Artificial Sequence
  Synthetic Oligonucleotide
gaaguacugauuuagcauguuguucau

SEQ ID NO: 405 - RNA, 27 nt, Artificial Sequence
  Synthetic Oligonucleotide
ggaaguacugauuuagcauguuguuca

SEQ ID NO: 406 - RNA, 27 nt, Artificial Sequence
  Synthetic Oligonucleotide
uuuggaaguacugauuuagcauguugu

SEQ ID NO: 407 - RNA, 27 nt, Artificial Sequence
  Synthetic Oligonucleotide
uauauagacuuuggaaguacugauuua

SEQ ID NO: 408 - RNA, 27 nt, Artificial Sequence
  Synthetic Oligonucleotide
auauauagacuuuggaaguacugauuu

SEQ ID NO: 409 - RNA, 27 nt, Artificial Sequence
  Synthetic Oligonucleotide
ucauauauagacuuuggaaguacugau

SEQ ID NO: 410 - RNA, 27 nt, Artificial Sequence
  Synthetic Oligonucleotide
gucauauauagacuuuggaaguacuga

SEQ ID NO: 411 - RNA, 27 nt, Artificial Sequence
  Synthetic Oligonucleotide
agucauauauagacuuuggaaguacug

SEQ ID NO: 412 - RNA, 27 nt, Artificial Sequence
  Synthetic Oligonucleotide
aauagucauauauagacuuuggaagua

SEQ ID NO: 413 - RNA, 27 nt, Artificial Sequence
  Synthetic Oligonucleotide
uguaauagucauauauagacuuuggaa

SEQ ID NO: 414 - RNA, 27 nt, Artificial Sequence
  Synthetic Oligonucleotide
cuguaauagucauauauagacuuugga

SEQ ID NO: 415 - RNA, 27 nt, Artificial Sequence
  Synthetic Oligonucleotide
accuguaauagucauauauagacuuug

SEQ ID NO: 416 - RNA, 27 nt, Artificial Sequence
  Synthetic Oligonucleotide
uugccccagaccuguaauagucauaua

SEQ ID NO: 417 - RNA, 27 nt, Artificial Sequence
  Synthetic Oligonucleotide
uuugccccagaccuguaauagucauau

SEQ ID NO: 418 - RNA, 27 nt, Artificial Sequence
  Synthetic Oligonucleotide
auuugccccagaccuguaauagucaua

SEQ ID NO: 419 - RNA, 27 nt, Artificial Sequence
  Synthetic Oligonucleotide
cauuugccccagaccuguaauagucau

SEQ ID NO: 420 - RNA, 27 nt, Artificial Sequence
  Synthetic Oligonucleotide
ucauuugccccagaccuguaauaguca

SEQ ID NO: 421 - RNA, 27 nt, Artificial Sequence
  Synthetic Oligonucleotide
aucauuugccccagaccuguaauaguc

SEQ ID NO: 422 - RNA, 27 nt, Artificial Sequence
  Synthetic Oligonucleotide
caucauuugccccagaccuguaauagu

SEQ ID NO: 423 - RNA, 27 nt, Artificial Sequence
  Synthetic Oligonucleotide
ucaucauuugccccagaccuguaauag

SEQ ID NO: 424 - RNA, 27 nt, Artificial Sequence
  Synthetic Oligonucleotide
uucaucauuugccccagaccuguaaua

SEQ ID NO: 425 - RNA, 27 nt, Artificial Sequence
  Synthetic Oligonucleotide
cuucaucauuugccccagaccuguaau

SEQ ID NO: 426 - RNA, 27 nt, Artificial Sequence
  Synthetic Oligonucleotide
ucuucaucauuugccccagaccuguaa

SEQ ID NO: 427 - RNA, 27 nt, Artificial Sequence
  Synthetic Oligonucleotide
uucuucaucauuugccccagaccugua

SEQ ID NO: 428 - RNA, 27 nt, Artificial Sequence
  Synthetic Oligonucleotide
gacagaucuguuucagcaacauuccgg

SEQ ID NO: 429 - RNA, 27 nt, Artificial Sequence
  Synthetic Oligonucleotide
ugacccucuguccuaaaacagaagucg

SEQ ID NO: 430 - RNA, 27 nt, Artificial Sequence
  Synthetic Oligonucleotide
cugacccucuguccuaaaacagaaguc

SEQ ID NO: 431 - RNA, 27 nt, Artificial Sequence
  Synthetic Oligonucleotide
ccacugucacaaauauggccuuguagc

SEQ ID NO: 432 - RNA, 27 nt, Artificial Sequence
  Synthetic Oligonucleotide
uccacugucacaaauauggccuuguag

SEQ ID NO: 433 - RNA, 27 nt, Artificial Sequence
  Synthetic Oligonucleotide
caaaauuuuucauccugaguuguggcg

SEQ ID NO: 434 - RNA, 27 nt, Artificial Sequence
  Synthetic Oligonucleotide
ucaaaauuuuucauccugaguuguggc

SEQ ID NO: 435 - RNA, 27 nt, Artificial Sequence
  Synthetic Oligonucleotide
uucaaaauuuuucauccugaguugugg

SEQ ID NO: 436 - RNA, 27 nt, Artificial Sequence
  Synthetic Oligonucleotide
uuucaaaauuuuucauccugaguugug

SEQ ID NO: 437 - RNA, 27 nt, Artificial Sequence
  Synthetic Oligonucleotide
guuucaaaauuuuucauccugaguugu

SEQ ID NO: 438 - RNA, 27 nt, Artificial Sequence
  Synthetic Oligonucleotide
ugguuucaaaauuuuucauccugaguu

SEQ ID NO: 439 - RNA, 27 nt, Artificial Sequence
  Synthetic Oligonucleotide
cugguuucaaaauuuuucauccugagu

SEQ ID NO: 440 - RNA, 27 nt, Artificial Sequence
  Synthetic Oligonucleotide
acugguuucaaaauuuuucauccugag

SEQ ID NO: 441 - RNA, 27 nt, Artificial Sequence
  Synthetic Oligonucleotide
uacugguuucaaaauuuuucauccuga

SEQ ID NO: 442 - RNA, 27 nt, Artificial Sequence
  Synthetic Oligonucleotide
aguacugguuucaaaauuuuucauccu

SEQ ID NO: 443 - RNA, 27 nt, Artificial Sequence
  Synthetic Oligonucleotide
aaguacugguuucaaaauuuuucaucc

SEQ ID NO: 444 - RNA, 27 nt, Artificial Sequence
  Synthetic Oligonucleotide
aaaguacugguuucaaaauuuuucauc

SEQ ID NO: 445 - RNA, 27 nt, Artificial Sequence
  Synthetic Oligonucleotide
uaaaguacugguuucaaaauuuuucau

SEQ ID NO: 446 - RNA, 27 nt, Artificial Sequence
  Synthetic Oligonucleotide
auaaaguacugguuucaaaauuuuuca

SEQ ID NO: 447 - RNA, 27 nt, Artificial Sequence
  Synthetic Oligonucleotide
gauaaaguacugguuucaaaauuuuuc

SEQ ID NO: 448 - RNA, 27 nt, Artificial Sequence
  Synthetic Oligonucleotide
ugauaaaguacugguuucaaaauuuuu

SEQ ID NO: 449 - RNA, 27 nt, Artificial Sequence
  Synthetic Oligonucleotide
augauaaaguacugguuucaaaauuuu

SEQ ID NO: 450 - RNA, 27 nt, Artificial Sequence
  Synthetic Oligonucleotide
aaugauaaaguacugguuucaaaauuu

SEQ ID NO: 451 - RNA, 27 nt, Artificial Sequence
  Synthetic Oligonucleotide
aaaugauaaaguacugguuucaaaauu

SEQ ID NO: 452 - RNA, 27 nt, Artificial Sequence
  Synthetic Oligonucleotide
aaaaugauaaaguacugguuucaaaau

SEQ ID NO: 453 - RNA, 27 nt, Artificial Sequence
  Synthetic Oligonucleotide
gaaaaugauaaaguacugguuucaaaa

SEQ ID NO: 454 - RNA, 27 nt, Artificial Sequence
  Synthetic Oligonucleotide
agaaaaugauaaaguacugguuucaaa

SEQ ID NO: 455 - RNA, 27 nt, Artificial Sequence
  Synthetic Oligonucleotide
gagaaaaugauaaaguacugguuucaa

SEQ ID NO: 456 - RNA, 27 nt, Artificial Sequence
  Synthetic Oligonucleotide
ggagaaaaugauaaaguacugguuuca

SEQ ID NO: 457 - RNA, 27 nt, Artificial Sequence
  Synthetic Oligonucleotide
aggagaaaaugauaaaguacugguuuc

SEQ ID NO: 458 - RNA, 27 nt, Artificial Sequence
  Synthetic Oligonucleotide
ucaggagaaaaugauaaaguacugguu

SEQ ID NO: 459 - RNA, 27 nt, Artificial Sequence
  Synthetic Oligonucleotide
cucaggagaaaaugauaaaguacuggu

SEQ ID NO: 460 - RNA, 27 nt, Artificial Sequence
  Synthetic Oligonucleotide
aaaauuuuccucaggagaaaaugauaa

SEQ ID NO: 461 - RNA, 27 nt, Artificial Sequence
  Synthetic Oligonucleotide
aaugaugucagucuucucagccauuug

SEQ ID NO: 462 - RNA, 27 nt, Artificial Sequence
  Synthetic Oligonucleotide
aucaucaccucucaaaaugcccuuugc

SEQ ID NO: 463 - RNA, 27 nt, Artificial Sequence
  Synthetic Oligonucleotide
caucaucaccucucaaaaugcccuuug

SEQ ID NO: 464 - RNA, 27 nt, Artificial Sequence
  Synthetic Oligonucleotide
gcaucaucaccucucaaaaugcccuuu

SEQ ID NO: 465 - RNA, 27 nt, Artificial Sequence
  Synthetic Oligonucleotide
ggcaucaucaccucucaaaaugcccuu

SEQ ID NO: 466 - RNA, 27 nt, Artificial Sequence
  Synthetic Oligonucleotide
uggcaucaucaccucucaaaaugcccu

SEQ ID NO: 467 - RNA, 27 nt, Artificial Sequence
  Synthetic Oligonucleotide
cuggcaucaucaccucucaaaaugccc

SEQ ID NO: 468 - RNA, 27 nt, Artificial Sequence
  Synthetic Oligonucleotide
ccuggcaucaucaccucucaaaaugcc

SEQ ID NO: 469 - RNA, 27 nt, Artificial Sequence
  Synthetic Oligonucleotide
cccuggcaucaucaccucucaaaaugc

SEQ ID NO: 470 - RNA, 27 nt, Artificial Sequence
  Synthetic Oligonucleotide
ucccuggcaucaucaccucucaaaaug

SEQ ID NO: 471 - RNA, 27 nt, Artificial Sequence
  Synthetic Oligonucleotide
cucccuggcaucaucaccucucaaaau

SEQ ID NO: 472 - RNA, 27 nt, Artificial Sequence
  Synthetic Oligonucleotide
ccucccuggcaucaucaccucucaaaa

SEQ ID NO: 473 - RNA, 27 nt, Artificial Sequence
  Synthetic Oligonucleotide
ccaugauucgacaccaagaucccauuc

SEQ ID NO: 474 - RNA, 27 nt, Artificial Sequence
  Synthetic Oligonucleotide
cccaugauucgacaccaagaucccauu

SEQ ID NO: 475 - RNA, 27 nt, Artificial Sequence
  Synthetic Oligonucleotide
ccccaugauucgacaccaagaucccau

SEQ ID NO: 476 - RNA, 27 nt, Artificial Sequence
  Synthetic Oligonucleotide
gccccaugauucgacaccaagauccca

SEQ ID NO: 477 - RNA, 27 nt, Artificial Sequence
  Synthetic Oligonucleotide
agccccaugauucgacaccaagauccc

SEQ ID NO: 478 - RNA, 27 nt, Artificial Sequence
  Synthetic Oligonucleotide
gagccccaugauucgacaccaagaucc

SEQ ID NO: 479 - RNA, 27 nt, Artificial Sequence
  Synthetic Oligonucleotide
cgagccccaugauucgacaccaagauc

SEQ ID NO: 480 - RNA, 27 nt, Artificial Sequence
  Synthetic Oligonucleotide
ucgagccccaugauucgacaccaagau

SEQ ID NO: 481 - RNA, 27 nt, Artificial Sequence
  Synthetic Oligonucleotide
gucgagccccaugauucgacaccaaga

SEQ ID NO: 482 - RNA, 27 nt, Artificial Sequence
  Synthetic Oligonucleotide
ugucgagccccaugauucgacaccaag

SEQ ID NO: 483 - RNA, 27 nt, Artificial Sequence
  Synthetic Oligonucleotide
auuucuggcagaacaucaauaguggcu

SEQ ID NO: 484 - RNA, 27 nt, Artificial Sequence
  Synthetic Oligonucleotide
acaauuucuggcagaacaucaauagug

SEQ ID NO: 485 - RNA, 27 nt, Artificial Sequence
  Synthetic Oligonucleotide
cacaauuucuggcagaacaucaauagu

SEQ ID NO: 486 - RNA, 27 nt, Artificial Sequence
  Synthetic Oligonucleotide
cuuccaccuucccuuccacagccucca

SEQ ID NO: 487 - RNA, 27 nt, Artificial Sequence
  Synthetic Oligonucleotide
acuuccaccuucccuuccacagccucc

SEQ ID NO: 488 - RNA, 27 nt, Artificial Sequence
  Synthetic Oligonucleotide
gaggacaucuugaacaccuuucucccc

SEQ ID NO: 489 - RNA, 27 nt, Artificial Sequence
  Synthetic Oligonucleotide
cgaggacaucuugaacaccuuucuccc

SEQ ID NO: 490 - RNA, 27 nt, Artificial Sequence
  Synthetic Oligonucleotide
ucgaggacaucuugaacaccuuucucc

SEQ ID NO: 491 - RNA, 27 nt, Artificial Sequence
  Synthetic Oligonucleotide
cucgaggacaucuugaacaccuuucuc

SEQ ID NO: 492 - RNA, 27 nt, Artificial Sequence
  Synthetic Oligonucleotide
ucucgaggacaucuugaacaccuuucu

SEQ ID NO: 493 - RNA, 27 nt, Artificial Sequence
  Synthetic Oligonucleotide
aucucgaggacaucuugaacaccuuuc

SEQ ID NO: 494 - RNA, 27 nt, Artificial Sequence
  Synthetic Oligonucleotide
uaucucgaggacaucuugaacaccuuu

SEQ ID NO: 495 - RNA, 27 nt, Artificial Sequence
  Synthetic Oligonucleotide
guaucucgaggacaucuugaacaccuu

SEQ ID NO: 496 - RNA, 27 nt, Artificial Sequence
  Synthetic Oligonucleotide
aguaucucgaggacaucuugaacaccu

SEQ ID NO: 497 - RNA, 27 nt, Artificial Sequence
  Synthetic Oligonucleotide
uaguaucucgaggacaucuugaacacc

SEQ ID NO: 498 - RNA, 27 nt, Artificial Sequence
  Synthetic Oligonucleotide
uuaguaucucgaggacaucuugaacac

SEQ ID NO: 499 - RNA, 27 nt, Artificial Sequence
  Synthetic Oligonucleotide
uuuaguaucucgaggacaucuugaaca

SEQ ID NO: 500 - RNA, 27 nt, Artificial Sequence
  Synthetic Oligonucleotide
cuuuaguaucucgaggacaucuugaac

SEQ ID NO: 501 - RNA, 27 nt, Artificial Sequence
  Synthetic Oligonucleotide
uggcacccacucagagccauggccaac

SEQ ID NO: 502 - RNA, 27 nt, Artificial Sequence
  Synthetic Oligonucleotide
cuggcacccacucagagccauggccaa

SEQ ID NO: 503 - RNA, 27 nt, Artificial Sequence
  Synthetic Oligonucleotide
ucuggcacccacucagagccauggcca

SEQ ID NO: 504 - RNA, 27 nt, Artificial Sequence
  Synthetic Oligonucleotide
uucuggcacccacucagagccauggcc

SEQ ID NO: 505 - RNA, 27 nt, Artificial Sequence
  Synthetic Oligonucleotide
auucuggcacccacucagagccauggc

SEQ ID NO: 506 - RNA, 27 nt, Artificial Sequence
  Synthetic Oligonucleotide
cauucuggcacccacucagagccaugg

SEQ ID NO: 507 - RNA, 27 nt, Artificial Sequence
  Synthetic Oligonucleotide
acauucuggcacccacucagagccaug

SEQ ID NO: 508 - RNA, 27 nt, Artificial Sequence
  Synthetic Oligonucleotide
cacauucuggcacccacucagagccau

SEQ ID NO: 509 - RNA, 27 nt, Artificial Sequence
  Synthetic Oligonucleotide
ucacauucuggcacccacucagagcca

SEQ ID NO: 510 - RNA, 27 nt, Artificial Sequence
  Synthetic Oligonucleotide
uucacauucuggcacccacucagagcc

SEQ ID NO: 511 - RNA, 27 nt, Artificial Sequence
  Synthetic Oligonucleotide
uuucacauucuggcacccacucagagc

SEQ ID NO: 512 - RNA, 27 nt, Artificial Sequence
  Synthetic Oligonucleotide
cuuucacauucuggcacccacucagag

SEQ ID NO: 513 - RNA, 27 nt, Artificial Sequence
  Synthetic Oligonucleotide
acuuucacauucuggcacccacucaga

SEQ ID NO: 514 - RNA, 27 nt, Artificial Sequence
  Synthetic Oligonucleotide
gacuuucacauucuggcacccacucag

SEQ ID NO: 515 - RNA, 27 nt, Artificial Sequence
  Synthetic Oligonucleotide
ugacuuucacauucuggcacccacuca

SEQ ID NO: 516 - RNA, 27 nt, Artificial Sequence
  Synthetic Oligonucleotide
augacuuucacauucuggcacccacuc

SEQ ID NO: 517 - RNA, 27 nt, Artificial Sequence
  Synthetic Oligonucleotide
gaugacuuucacauucuggcacccacu

SEQ ID NO: 518 - RNA, 27 nt, Artificial Sequence
  Synthetic Oligonucleotide
cgaugacuuucacauucuggcacccac

SEQ ID NO: 519 - RNA, 27 nt, Artificial Sequence
  Synthetic Oligonucleotide
ucgaugacuuucacauucuggcaccca

SEQ ID NO: 520 - RNA, 27 nt, Artificial Sequence
  Synthetic Oligonucleotide
gucgaugacuuucacauucuggcaccc

SEQ ID NO: 521 - RNA, 27 nt, Artificial Sequence
  Synthetic Oligonucleotide
ugucgaugacuuucacauucuggcacc

SEQ ID NO: 522 - RNA, 27 nt, Artificial Sequence
  Synthetic Oligonucleotide
uugucgaugacuuucacauucuggcac

SEQ ID NO: 523 - RNA, 27 nt, Artificial Sequence
  Synthetic Oligonucleotide
cuugucgaugacuuucacauucuggca

SEQ ID NO: 524 - RNA, 27 nt, Artificial Sequence
  Synthetic Oligonucleotide
ucuugucgaugacuuucacauucuggc

SEQ ID NO: 525 - RNA, 27 nt, Artificial Sequence
  Synthetic Oligonucleotide
gucuugucgaugacuuucacauucugg

SEQ ID NO: 526 - RNA, 27 nt, Artificial Sequence
  Synthetic Oligonucleotide
ugucuugucgaugacuuucacauucug

SEQ ID NO: 527 - RNA, 27 nt, Artificial Sequence
  Synthetic Oligonucleotide
augucuugucgaugacuuucacauucu

SEQ ID NO: 528 - RNA, 27 nt, Artificial Sequence
  Synthetic Oligonucleotide
aaugucuugucgaugacuuucacauuc

SEQ ID NO: 529 - RNA, 27 nt, Artificial Sequence
  Synthetic Oligonucleotide
caaugucuugucgaugacuuucacauu

SEQ ID NO: 530 - RNA, 27 nt, Artificial Sequence
  Synthetic Oligonucleotide
ccaaugucuugucgaugacuuucacau

SEQ ID NO: 531 - RNA, 27 nt, Artificial Sequence
  Synthetic Oligonucleotide
accaaugucuugucgaugacuuucaca

SEQ ID NO: 532 - RNA, 27 nt, Artificial Sequence
  Synthetic Oligonucleotide
caccaaugucuugucgaugacuuucac

SEQ ID NO: 533 - RNA, 27 nt, Artificial Sequence
  Synthetic Oligonucleotide
ucaccaaugucuugucgaugacuuuca

SEQ ID NO: 534 - RNA, 27 nt, Artificial Sequence
  Synthetic Oligonucleotide
cucaccaaugucuugucgaugacuuuc

SEQ ID NO: 535 - RNA, 27 nt, Artificial Sequence
  Synthetic Oligonucleotide
ccucaccaaugucuugucgaugacuuu

SEQ ID NO: 536 - RNA, 27 nt, Artificial Sequence
  Synthetic Oligonucleotide
uccucaccaaugucuugucgaugacuu

SEQ ID NO: 537 - RNA, 27 nt, Artificial Sequence
  Synthetic Oligonucleotide
uuccucaccaaugucuugucgaugacu

SEQ ID NO: 538 - RNA, 27 nt, Artificial Sequence
  Synthetic Oligonucleotide
uuuccucaccaaugucuugucgaugac

SEQ ID NO: 539 - RNA, 27 nt, Artificial Sequence
  Synthetic Oligonucleotide
uuuuccucaccaaugucuugucgauga

SEQ ID NO: 540 - RNA, 27 nt, Artificial Sequence
  Synthetic Oligonucleotide
uuuuuccucaccaaugucuugucgaug

SEQ ID NO: 541 - RNA, 27 nt, Artificial Sequence
  Synthetic Oligonucleotide
auuuuuccucaccaaugucuugucgau

SEQ ID NO: 542 - RNA, 27 nt, Artificial Sequence
  Synthetic Oligonucleotide
gauuuuuccucaccaaugucuugucga

SEQ ID NO: 543 - RNA, 27 nt, Artificial Sequence
  Synthetic Oligonucleotide
ggauuuuuccucaccaaugucuugucg

SEQ ID NO: 544 - RNA, 27 nt, Artificial Sequence
  Synthetic Oligonucleotide
aggauuuuuccucaccaaugucuuguc

SEQ ID NO: 545 - RNA, 27 nt, Artificial Sequence
  Synthetic Oligonucleotide
aaggauuuuuccucaccaaugucuugu

SEQ ID NO: 546 - RNA, 27 nt, Artificial Sequence
  Synthetic Oligonucleotide
aaaggauuuuuccucaccaaugucuug

SEQ ID NO: 547 - RNA, 27 nt, Artificial Sequence
  Synthetic Oligonucleotide
caaaggauuuuuccucaccaaugucuu

SEQ ID NO: 548 - RNA, 27 nt, Artificial Sequence
  Synthetic Oligonucleotide
ccaaaggauuuuuccucaccaaugucu

SEQ ID NO: 549 - RNA, 27 nt, Artificial Sequence
  Synthetic Oligonucleotide
gccaaaggauuuuuccucaccaauguc

SEQ ID NO: 550 - RNA, 27 nt, Artificial Sequence
  Synthetic Oligonucleotide
ggccaaaggauuuuuccucaccaaugu

SEQ ID NO: 551 - RNA, 27 nt, Artificial Sequence
  Synthetic Oligonucleotide
cggccaaaggauuuuuccucaccaaug

SEQ ID NO: 552 - RNA, 27 nt, Artificial Sequence
  Synthetic Oligonucleotide
acggccaaaggauuuuuccucaccaau

SEQ ID NO: 553 - RNA, 27 nt, Artificial Sequence
  Synthetic Oligonucleotide
aacggccaaaggauuuuuccucaccaa

SEQ ID NO: 554 - RNA, 27 nt, Artificial Sequence
  Synthetic Oligonucleotide
aaacggccaaaggauuuuuccucacca

SEQ ID NO: 555 - RNA, 27 nt, Artificial Sequence
  Synthetic Oligonucleotide
gaaacggccaaaggauuuuuccucacc

SEQ ID NO: 556 - RNA, 27 nt, Artificial Sequence
  Synthetic Oligonucleotide
uugugcacugucagaucuuggaaacgg

SEQ ID NO: 557 - RNA, 27 nt, Artificial Sequence
  Synthetic Oligonucleotide
auugugcacugucagaucuuggaaacg

SEQ ID NO: 558 - RNA, 27 nt, Artificial Sequence
  Synthetic Oligonucleotide
uauugugcacugucagaucuuggaaac

SEQ ID NO: 559 - RNA, 27 nt, Artificial Sequence
  Synthetic Oligonucleotide
auauugugcacugucagaucuuggaaa

SEQ ID NO: 560 - RNA, 27 nt, Artificial Sequence
  Synthetic Oligonucleotide
aauauugugcacugucagaucuuggaa

SEQ ID NO: 561 - RNA, 27 nt, Artificial Sequence
  Synthetic Oligonucleotide
aaauauugugcacugucagaucuugga

SEQ ID NO: 562 - RNA, 27 nt, Artificial Sequence
  Synthetic Oligonucleotide
aaaauauugugcacugucagaucuugg

SEQ ID NO: 563 - RNA, 27 nt, Artificial Sequence
  Synthetic Oligonucleotide
gaaaauauugugcacugucagaucuug

SEQ ID NO: 564 - RNA, 27 nt, Artificial Sequence
  Synthetic Oligonucleotide
ggaaaauauugugcacugucagaucuu

SEQ ID NO: 565 - RNA, 27 nt, Artificial Sequence
  Synthetic Oligonucleotide
gggaaaauauugugcacugucagaucu

SEQ ID NO: 566 - RNA, 27 nt, Artificial Sequence
  Synthetic Oligonucleotide
ugggaaaauauugugcacugucagauc

SEQ ID NO: 567 - RNA, 27 nt, Artificial Sequence
  Synthetic Oligonucleotide
augggaaaauauugugcacugucagau

SEQ ID NO: 568 - RNA, 27 nt, Artificial Sequence
  Synthetic Oligonucleotide
gaugggaaaauauugugcacugucaga

SEQ ID NO: 569 - RNA, 27 nt, Artificial Sequence
  Synthetic Oligonucleotide
agaugggaaaauauugugcacugucag

SEQ ID NO: 570 - RNA, 27 nt, Artificial Sequence
  Synthetic Oligonucleotide
cagaugggaaaauauugugcacuguca

SEQ ID NO: 571 - RNA, 27 nt, Artificial Sequence
  Synthetic Oligonucleotide
acagaugggaaaauauugugcacuguc

SEQ ID NO: 572 - RNA, 27 nt, Artificial Sequence
  Synthetic Oligonucleotide
uacagaugggaaaauauugugcacugu

SEQ ID NO: 573 - RNA, 27 nt, Artificial Sequence
  Synthetic Oligonucleotide
auacagaugggaaaauauugugcacug

SEQ ID NO: 574 - RNA, 27 nt, Artificial Sequence
  Synthetic Oligonucleotide
aauacagaugggaaaauauugugcacu

SEQ ID NO: 575 - RNA, 27 nt, Artificial Sequence
  Synthetic Oligonucleotide
uaauacagaugggaaaauauugugcac

SEQ ID NO: 576 - RNA, 27 nt, Artificial Sequence
  Synthetic Oligonucleotide
auaauacagaugggaaaauauugugca

SEQ ID NO: 577 - RNA, 27 nt, Artificial Sequence
  Synthetic Oligonucleotide
aauaauacagaugggaaaauauugugc

SEQ ID NO: 578 - RNA, 27 nt, Artificial Sequence
  Synthetic Oligonucleotide
aaauaauacagaugggaaaauauugug

SEQ ID NO: 579 - RNA, 27 nt, Artificial Sequence
  Synthetic Oligonucleotide
aaaauaauacagaugggaaaauauugu

SEQ ID NO: 580 - RNA, 27 nt, Artificial Sequence
  Synthetic Oligonucleotide
aaaaauaauacagaugggaaaauauug

SEQ ID NO: 581 - RNA, 27 nt, Artificial Sequence
  Synthetic Oligonucleotide
aaaaaauaauacagaugggaaaauauu

SEQ ID NO: 582 - RNA, 27 nt, Artificial Sequence
  Synthetic Oligonucleotide
aaaaaaauaauacagaugggaaaauau

SEQ ID NO: 583 - RNA, 27 nt, Artificial Sequence
  Synthetic Oligonucleotide
uugucaaguaauacaugcugaaaaaaa

SEQ ID NO: 584 - RNA, 27 nt, Artificial Sequence
  Synthetic Oligonucleotide
uuugucaaguaauacaugcugaaaaaa

SEQ ID NO: 585 - RNA, 27 nt, Artificial Sequence
  Synthetic Oligonucleotide
cuuugucaaguaauacaugcugaaaaa

SEQ ID NO: 586 - RNA, 27 nt, Artificial Sequence
  Synthetic Oligonucleotide
ucuuugucaaguaauacaugcugaaaa

SEQ ID NO: 587 - RNA, 27 nt, Artificial Sequence
  Synthetic Oligonucleotide
cucuuugucaaguaauacaugcugaaa

SEQ ID NO: 588 - RNA, 27 nt, Artificial Sequence
  Synthetic Oligonucleotide
ucucuuugucaaguaauacaugcugaa

SEQ ID NO: 589 - RNA, 27 nt, Artificial Sequence
  Synthetic Oligonucleotide
gucucuuugucaaguaauacaugcuga

SEQ ID NO: 590 - RNA, 27 nt, Artificial Sequence
  Synthetic Oligonucleotide
ugucucuuugucaaguaauacaugcug

SEQ ID NO: 591 - RNA, 27 nt, Artificial Sequence
  Synthetic Oligonucleotide
gugucucuuugucaaguaauacaugcu

SEQ ID NO: 592 - RNA, 27 nt, Artificial Sequence
  Synthetic Oligonucleotide
cacagugucucuuugucaaguaauaca

SEQ ID NO: 593 - RNA, 27 nt, Artificial Sequence
  Synthetic Oligonucleotide
gcacagugucucuuugucaaguaauac

SEQ ID NO: 594 - RNA, 27 nt, Artificial Sequence
  Synthetic Oligonucleotide
ugcacagugucucuuugucaaguaaua

SEQ ID NO: 595 - RNA, 27 nt, Artificial Sequence
  Synthetic Oligonucleotide
cugcacagugucucuuugucaaguaau

SEQ ID NO: 596 - RNA, 27 nt, Artificial Sequence
  Synthetic Oligonucleotide
ucugcacagugucucuuugucaaguaa

SEQ ID NO: 597 - RNA, 27 nt, Artificial Sequence
  Synthetic Oligonucleotide
cucugcacagugucucuuugucaagua

SEQ ID NO: 598 - RNA, 27 nt, Artificial Sequence
  Synthetic Oligonucleotide
ccucugcacagugucucuuugucaagu

SEQ ID NO: 599 - RNA, 27 nt, Artificial Sequence
  Synthetic Oligonucleotide
cccucugcacagugucucuuugucaag

SEQ ID NO: 600 - RNA, 27 nt, Artificial Sequence
  Synthetic Oligonucleotide
acccucugcacagugucucuuugucaa

SEQ ID NO: 601 - RNA, 27 nt, Artificial Sequence
  Synthetic Oligonucleotide
cacccucugcacagugucucuuuguca

SEQ ID NO: 602 - RNA, 27 nt, Artificial Sequence
  Synthetic Oligonucleotide
ucacccucugcacagugucucuuuguc

SEQ ID NO: 603 - RNA, 27 nt, Artificial Sequence
  Synthetic Oligonucleotide
gucacccucugcacagugucucuuugu

SEQ ID NO: 604 - RNA, 27 nt, Artificial Sequence
  Synthetic Oligonucleotide
ggucacccucugcacagugucucuuug

SEQ ID NO: 605 - RNA, 27 nt, Artificial Sequence
  Synthetic Oligonucleotide
uggucacccucugcacagugucucuuu

SEQ ID NO: 606 - RNA, 27 nt, Artificial Sequence
  Synthetic Oligonucleotide
guggucacccucugcacagugucucuu

SEQ ID NO: 607 - RNA, 27 nt, Artificial Sequence
  Synthetic Oligonucleotide
uguggucacccucugcacagugucucu

SEQ ID NO: 608 - RNA, 27 nt, Artificial Sequence
  Synthetic Oligonucleotide
cuguggucacccucugcacagugucuc

SEQ ID NO: 609 - RNA, 27 nt, Artificial Sequence
  Synthetic Oligonucleotide
acuguggucacccucugcacagugucu

SEQ ID NO: 610 - RNA, 27 nt, Artificial Sequence
  Synthetic Oligonucleotide
gacuguggucacccucugcacaguguc

SEQ ID NO: 611 - RNA, 27 nt, Artificial Sequence
  Synthetic Oligonucleotide
agacuguggucacccucugcacagugu

SEQ ID NO: 612 - RNA, 27 nt, Artificial Sequence
  Synthetic Oligonucleotide
cagacuguggucacccucugcacagug

SEQ ID NO: 613 - RNA, 27 nt, Artificial Sequence
  Synthetic Oligonucleotide
acagacuguggucacccucugcacagu

SEQ ID NO: 614 - RNA, 27 nt, Artificial Sequence
  Synthetic Oligonucleotide
uacagacuguggucacccucugcacag

SEQ ID NO: 615 - RNA, 27 nt, Artificial Sequence
  Synthetic Oligonucleotide
uguauugaaguggggaauuacagacug

SEQ ID NO: 616 - RNA, 27 nt, Artificial Sequence
  Synthetic Oligonucleotide
uuguauugaaguggggaauuacagacu

SEQ ID NO: 617 - RNA, 27 nt, Artificial Sequence
  Synthetic Oligonucleotide
uuuguauugaaguggggaauuacagac

SEQ ID NO: 618 - RNA, 27 nt, Artificial Sequence
  Synthetic Oligonucleotide
cuuuguauugaaguggggaauuacaga

SEQ ID NO: 619 - RNA, 27 nt, Artificial Sequence
  Synthetic Oligonucleotide
uggaaaagaacgacacccuuuguauug

SEQ ID NO: 620 - RNA, 27 nt, Artificial Sequence
  Synthetic Oligonucleotide
uuggaaaagaacgacacccuuuguauu

SEQ ID NO: 621 - RNA, 27 nt, Artificial Sequence
  Synthetic Oligonucleotide
guuggaaaagaacgacacccuuuguau

SEQ ID NO: 622 - RNA, 27 nt, Artificial Sequence
  Synthetic Oligonucleotide
uguuggaaaagaacgacacccuuugua

SEQ ID NO: 623 - RNA, 27 nt, Artificial Sequence
  Synthetic Oligonucleotide
uuguuggaaaagaacgacacccuuugu

SEQ ID NO: 624 - RNA, 27 nt, Artificial Sequence
  Synthetic Oligonucleotide
uuuguuggaaaagaacgacacccuuug

SEQ ID NO: 625 - RNA, 27 nt, Artificial Sequence
  Synthetic Oligonucleotide
uuuuguuggaaaagaacgacacccuuu

SEQ ID NO: 626 - RNA, 27 nt, Artificial Sequence
  Synthetic Oligonucleotide
auuuuguuggaaaagaacgacacccuu

SEQ ID NO: 627 - RNA, 27 nt, Artificial Sequence
  Synthetic Oligonucleotide
uauuuuguuggaaaagaacgacacccu

SEQ ID NO: 628 - RNA, 27 nt, Artificial Sequence
  Synthetic Oligonucleotide
cuauuuuguuggaaaagaacgacaccc

SEQ ID NO: 629 - RNA, 27 nt, Artificial Sequence
  Synthetic Oligonucleotide
gcuauuuuguuggaaaagaacgacacc

SEQ ID NO: 630 - RNA, 27 nt, Artificial Sequence
  Synthetic Oligonucleotide
ugcuauuuuguuggaaaagaacgacac

SEQ ID NO: 631 - RNA, 27 nt, Artificial Sequence
  Synthetic Oligonucleotide
uugcuauuuuguuggaaaagaacgaca

SEQ ID NO: 632 - RNA, 27 nt, Artificial Sequence
  Synthetic Oligonucleotide
auugcuauuuuguuggaaaagaacgac

SEQ ID NO: 633 - RNA, 27 nt, Artificial Sequence
  Synthetic Oligonucleotide
gauugcuauuuuguuggaaaagaacga

SEQ ID NO: 634 - RNA, 27 nt, Artificial Sequence
  Synthetic Oligonucleotide
ggauugcuauuuuguuggaaaagaacg

SEQ ID NO: 635 - RNA, 27 nt, Artificial Sequence
  Synthetic Oligonucleotide
gggauugcuauuuuguuggaaaagaac

SEQ ID NO: 636 - RNA, 27 nt, Artificial Sequence
  Synthetic Oligonucleotide
aauaaaagggauugcuauuuuguugga

SEQ ID NO: 637 - RNA, 27 nt, Artificial Sequence
  Synthetic Oligonucleotide
aaauaaaagggauugcuauuuuguugg

SEQ ID NO: 638 - RNA, 27 nt, Artificial Sequence
  Synthetic Oligonucleotide
gaaauaaaagggauugcuauuuuguug

SEQ ID NO: 639 - RNA, 27 nt, Artificial Sequence
  Synthetic Oligonucleotide
ugaaauaaaagggauugcuauuuuguu

SEQ ID NO: 640 - RNA, 27 nt, Artificial Sequence
  Synthetic Oligonucleotide
augaaauaaaagggauugcuauuuugu

SEQ ID NO: 641 - RNA, 27 nt, Artificial Sequence
  Synthetic Oligonucleotide
ccauugaaaagucaaaagcaaugaaau

SEQ ID NO: 642 - RNA, 27 nt, Artificial Sequence
  Synthetic Oligonucleotide
cccauugaaaagucaaaagcaaugaaa

SEQ ID NO: 643 - RNA, 27 nt, Artificial Sequence
  Synthetic Oligonucleotide
acccauugaaaagucaaaagcaaugaa

SEQ ID NO: 644 - RNA, 27 nt, Artificial Sequence
  Synthetic Oligonucleotide
cacccauugaaaagucaaaagcaauga

SEQ ID NO: 645 - RNA, 27 nt, Artificial Sequence
  Synthetic Oligonucleotide
acacccauugaaaagucaaaagcaaug

SEQ ID NO: 646 - RNA, 27 nt, Artificial Sequence
  Synthetic Oligonucleotide
gacacccauugaaaagucaaaagcaau

SEQ ID NO: 647 - RNA, 27 nt, Artificial Sequence
  Synthetic Oligonucleotide
ggacacccauugaaaagucaaaagcaa

SEQ ID NO: 648 - RNA, 27 nt, Artificial Sequence
  Synthetic Oligonucleotide
aggacacccauugaaaagucaaaagca

SEQ ID NO: 649 - RNA, 27 nt, Artificial Sequence
  Synthetic Oligonucleotide
uaggacacccauugaaaagucaaaagc

SEQ ID NO: 650 - RNA, 27 nt, Artificial Sequence
  Synthetic Oligonucleotide
cuaggacacccauugaaaagucaaaag

SEQ ID NO: 651 - RNA, 27 nt, Artificial Sequence
  Synthetic Oligonucleotide
ccuaggacacccauugaaaagucaaaa

SEQ ID NO: 652 - RNA, 27 nt, Artificial Sequence
  Synthetic Oligonucleotide
uccuaggacacccauugaaaagucaaa

SEQ ID NO: 653 - RNA, 27 nt, Artificial Sequence
  Synthetic Oligonucleotide
uuccuaggacacccauugaaaagucaa

SEQ ID NO: 654 - RNA, 27 nt, Artificial Sequence
  Synthetic Oligonucleotide
guuccuaggacacccauugaaaaguca

SEQ ID NO: 655 - RNA, 27 nt, Artificial Sequence
  Synthetic Oligonucleotide
gguuccuaggacacccauugaaaaguc

SEQ ID NO: 656 - RNA, 27 nt, Artificial Sequence
  Synthetic Oligonucleotide
agguuccuaggacacccauugaaaagu

SEQ ID NO: 657 - RNA, 27 nt, Artificial Sequence
  Synthetic Oligonucleotide
aagguuccuaggacacccauugaaaag

SEQ ID NO: 658 - RNA, 27 nt, Artificial Sequence
  Synthetic Oligonucleotide
aaagguuccuaggacacccauugaaaa

SEQ ID NO: 659 - RNA, 27 nt, Artificial Sequence
  Synthetic Oligonucleotide
aaaagguuccuaggacacccauugaaa

SEQ ID NO: 660 - RNA, 27 nt, Artificial Sequence
  Synthetic Oligonucleotide
uaaaagguuccuaggacacccauugaa

SEQ ID NO: 661 - RNA, 27 nt, Artificial Sequence
  Synthetic Oligonucleotide
cuaaaagguuccuaggacacccauuga

SEQ ID NO: 662 - RNA, 27 nt, Artificial Sequence
  Synthetic Oligonucleotide
ucuaaaagguuccuaggacacccauug

SEQ ID NO: 663 - RNA, 27 nt, Artificial Sequence
  Synthetic Oligonucleotide
uucuaaaagguuccuaggacacccauu

SEQ ID NO: 664 - RNA, 27 nt, Artificial Sequence
  Synthetic Oligonucleotide
auauuuccaggaugaaaguccauuucu

SEQ ID NO: 665 - RNA, 27 nt, Artificial Sequence
  Synthetic Oligonucleotide
uauauuuccaggaugaaaguccauuuc

SEQ ID NO: 666 - RNA, 27 nt, Artificial Sequence
  Synthetic Oligonucleotide
auauauuuccaggaugaaaguccauuu

SEQ ID NO: 667 - RNA, 27 nt, Artificial Sequence
  Synthetic Oligonucleotide
aauauauuuccaggaugaaaguccauu

SEQ ID NO: 668 - RNA, 27 nt, Artificial Sequence
  Synthetic Oligonucleotide
uaauauauuuccaggaugaaaguccau

SEQ ID NO: 669 - RNA, 27 nt, Artificial Sequence
  Synthetic Oligonucleotide
uuaauauauuuccaggaugaaagucca

SEQ ID NO: 670 - RNA, 27 nt, Artificial Sequence
  Synthetic Oligonucleotide
guuaauauauuuccaggaugaaagucc

SEQ ID NO: 671 - RNA, 27 nt, Artificial Sequence
  Synthetic Oligonucleotide
aguuaauauauuuccaggaugaaaguc

SEQ ID NO: 672 - RNA, 27 nt, Artificial Sequence
  Synthetic Oligonucleotide
caguuaauauauuuccaggaugaaagu

SEQ ID NO: 673 - RNA, 27 nt, Artificial Sequence
  Synthetic Oligonucleotide
acaguuaauauauuuccaggaugaaag

SEQ ID NO: 674 - RNA, 27 nt, Artificial Sequence
  Synthetic Oligonucleotide
aacaguuaauauauuuccaggaugaaa

SEQ ID NO: 675 - RNA, 27 nt, Artificial Sequence
  Synthetic Oligonucleotide
uaacaguuaauauauuuccaggaugaa

SEQ ID NO: 676 - RNA, 27 nt, Artificial Sequence
  Synthetic Oligonucleotide
uuaacaguuaauauauuuccaggauga

SEQ ID NO: 677 - RNA, 27 nt, Artificial Sequence
  Synthetic Oligonucleotide
uuuaacaguuaauauauuuccaggaug

SEQ ID NO: 678 - RNA, 27 nt, Artificial Sequence
  Synthetic Oligonucleotide
uuuuaacaguuaauauauuuccaggau

SEQ ID NO: 679 - RNA, 27 nt, Artificial Sequence
  Synthetic Oligonucleotide
uuuuuaacaguuaauauauuuccagga

SEQ ID NO: 680 - RNA, 27 nt, Artificial Sequence
  Synthetic Oligonucleotide
cuuuuuaacaguuaauauauuuccagg

SEQ ID NO: 681 - RNA, 27 nt, Artificial Sequence
  Synthetic Oligonucleotide
ucuuuuuaacaguuaauauauuuccag

SEQ ID NO: 682 - RNA, 27 nt, Artificial Sequence
  Synthetic Oligonucleotide
uucuuuuuaacaguuaauauauuucca

SEQ ID NO: 683 - RNA, 27 nt, Artificial Sequence
  Synthetic Oligonucleotide
uuucuuuuuaacaguuaauauauuucc

SEQ ID NO: 684 - RNA, 27 nt, Artificial Sequence
  Synthetic Oligonucleotide
uuuucuuuuuaacaguuaauauauuuc

SEQ ID NO: 685 - RNA, 27 nt, Artificial Sequence
  Synthetic Oligonucleotide
guuuucuuuuuaacaguuaauauauuu

SEQ ID NO: 686 - RNA, 27 nt, Artificial Sequence
  Synthetic Oligonucleotide
uguuuucuuuuuaacaguuaauauauu

SEQ ID NO: 687 - RNA, 27 nt, Artificial Sequence
  Synthetic Oligonucleotide
auguuuucuuuuuaacaguuaauauau

SEQ ID NO: 688 - RNA, 27 nt, Artificial Sequence
  Synthetic Oligonucleotide
aauguuuucuuuuuaacaguuaauaua

SEQ ID NO: 689 - RNA, 27 nt, Artificial Sequence
  Synthetic Oligonucleotide
caauguuuucuuuuuaacaguuaauau

SEQ ID NO: 690 - RNA, 27 nt, Artificial Sequence
  Synthetic Oligonucleotide
ucaauguuuucuuuuuaacaguuaaua

SEQ ID NO: 691 - RNA, 27 nt, Artificial Sequence
  Synthetic Oligonucleotide
uucaauguuuucuuuuuaacaguuaau

SEQ ID NO: 692 - RNA, 27 nt, Artificial Sequence
  Synthetic Oligonucleotide
uuucaauguuuucuuuuuaacaguuaa

SEQ ID NO: 693 - RNA, 27 nt, Artificial Sequence
  Synthetic Oligonucleotide
uuuucaauguuuucuuuuuaacaguua

SEQ ID NO: 694 - RNA, 27 nt, Artificial Sequence
  Synthetic Oligonucleotide
auuuucaauguuuucuuuuuaacaguu

SEQ ID NO: 695 - RNA, 27 nt, Artificial Sequence
  Synthetic Oligonucleotide
cauuuucaauguuuucuuuuuaacagu

SEQ ID NO: 696 - RNA, 27 nt, Artificial Sequence
  Synthetic Oligonucleotide
acauuuucaauguuuucuuuuuaacag

SEQ ID NO: 697 - RNA, 27 nt, Artificial Sequence
  Synthetic Oligonucleotide
cacauuuucaauguuuucuuuuuaaca

SEQ ID NO: 698 - RNA, 27 nt, Artificial Sequence
  Synthetic Oligonucleotide
uuuagccugccaggggaugacguuguc

SEQ ID NO: 699 - RNA, 27 nt, Artificial Sequence
  Synthetic Oligonucleotide
cuuuagccugccaggggaugacguugu

SEQ ID NO: 700 - RNA, 27 nt, Artificial Sequence
  Synthetic Oligonucleotide
acuuuagccugccaggggaugacguug

SEQ ID NO: 701 - RNA, 27 nt, Artificial Sequence
  Synthetic Oligonucleotide
cacuuuagccugccaggggaugacguu

SEQ ID NO: 702 - RNA, 27 nt, Artificial Sequence
  Synthetic Oligonucleotide
gcacuuuagccugccaggggaugacgu

SEQ ID NO: 703 - RNA, 27 nt, Artificial Sequence
  Synthetic Oligonucleotide
agcacuuuagccugccaggggaugacg

SEQ ID NO: 704 - RNA, 27 nt, Artificial Sequence
  Synthetic Oligonucleotide
cagcacuuuagccugccaggggaugac

SEQ ID NO: 705 - RNA, 27 nt, Artificial Sequence
  Synthetic Oligonucleotide
acagcacuuuagccugccaggggauga

SEQ ID NO: 706 - RNA, 27 nt, Artificial Sequence
  Synthetic Oligonucleotide
uacagcacuuuagccugccaggggaug

SEQ ID NO: 707 - RNA, 27 nt, Artificial Sequence
  Synthetic Oligonucleotide
auacagcacuuuagccugccaggggau

SEQ ID NO: 708 - RNA, 27 nt, Artificial Sequence
  Synthetic Oligonucleotide
gauacagcacuuuagccugccagggga

SEQ ID NO: 709 - RNA, 27 nt, Artificial Sequence
  Synthetic Oligonucleotide
ggauacagcacuuuagccugccagggg

SEQ ID NO: 710 - RNA, 27 nt, Artificial Sequence
  Synthetic Oligonucleotide
aggauacagcacuuuagccugccaggg

SEQ ID NO: 711 - RNA, 27 nt, Artificial Sequence
  Synthetic Oligonucleotide
aucuuuucaccuuaguguuugcuaccu

SEQ ID NO: 712 - RNA, 27 nt, Artificial Sequence
  Synthetic Oligonucleotide
uaucuuuucaccuuaguguuugcuacc

SEQ ID NO: 713 - RNA, 27 nt, Artificial Sequence
  Synthetic Oligonucleotide
uuaucuuuucaccuuaguguuugcuac

SEQ ID NO: 714 - RNA, 27 nt, Artificial Sequence
  Synthetic Oligonucleotide
auuaucuuuucaccuuaguguuugcua

SEQ ID NO: 715 - RNA, 27 nt, Artificial Sequence
  Synthetic Oligonucleotide
ucauuaucuuuucaccuuaguguuugc

SEQ ID NO: 716 - RNA, 27 nt, Artificial Sequence
  Synthetic Oligonucleotide
aucauuaucuuuucaccuuaguguuug

SEQ ID NO: 717 - RNA, 27 nt, Artificial Sequence
  Synthetic Oligonucleotide
ugagaucauuaucuuuucaccuuagug

SEQ ID NO: 718 - RNA, 27 nt, Artificial Sequence
  Synthetic Oligonucleotide
augagaucauuaucuuuucaccuuagu

SEQ ID NO: 719 - RNA, 27 nt, Artificial Sequence
  Synthetic Oligonucleotide
aaugagaucauuaucuuuucaccuuag

SEQ ID NO: 720 - RNA, 27 nt, Artificial Sequence
  Synthetic Oligonucleotide
caaugagaucauuaucuuuucaccuua

SEQ ID NO: 721 - RNA, 27 nt, Artificial Sequence
  Synthetic Oligonucleotide
acaaugagaucauuaucuuuucaccuu

SEQ ID NO: 722 - RNA, 27 nt, Artificial Sequence
  Synthetic Oligonucleotide
aacaaugagaucauuaucuuuucaccu

SEQ ID NO: 723 - RNA, 27 nt, Artificial Sequence
  Synthetic Oligonucleotide
aaacaaugagaucauuaucuuuucacc

SEQ ID NO: 724 - RNA, 27 nt, Artificial Sequence
  Synthetic Oligonucleotide
uaaacaaugagaucauuaucuuuucac

SEQ ID NO: 725 - RNA, 27 nt, Artificial Sequence
  Synthetic Oligonucleotide
auaaacaaugagaucauuaucuuuuca

SEQ ID NO: 726 - RNA, 27 nt, Artificial Sequence
  Synthetic Oligonucleotide
aauaaacaaugagaucauuaucuuuuc

SEQ ID NO: 727 - RNA, 27 nt, Artificial Sequence
  Synthetic Oligonucleotide
uaauaaacaaugagaucauuaucuuuu

SEQ ID NO: 728 - RNA, 27 nt, Artificial Sequence
  Synthetic Oligonucleotide
uuaauaaacaaugagaucauuaucuuu

SEQ ID NO: 729 - RNA, 27 nt, Artificial Sequence
  Synthetic Oligonucleotide
guuaauaaacaaugagaucauuaucuu

SEQ ID NO: 730 - RNA, 27 nt, Artificial Sequence
  Synthetic Oligonucleotide
gguuaauaaacaaugagaucauuaucu

SEQ ID NO: 731 - RNA, 27 nt, Artificial Sequence
  Synthetic Oligonucleotide
agguuaauaaacaaugagaucauuauc

SEQ ID NO: 732 - RNA, 27 nt, Artificial Sequence
  Synthetic Oligonucleotide
cagguuaauaaacaaugagaucauuau

SEQ ID NO: 733 - RNA, 27 nt, Artificial Sequence
  Synthetic Oligonucleotide
acagguuaauaaacaaugagaucauua

SEQ ID NO: 734 - RNA, 27 nt, Artificial Sequence
  Synthetic Oligonucleotide
uacagguuaauaaacaaugagaucauu

SEQ ID NO: 735 - RNA, 27 nt, Artificial Sequence
  Synthetic Oligonucleotide
auacagguuaauaaacaaugagaucau

SEQ ID NO: 736 - RNA, 27 nt, Artificial Sequence
  Synthetic Oligonucleotide
aauacagguuaauaaacaaugagauca

SEQ ID NO: 737 - RNA, 27 nt, Artificial Sequence
  Synthetic Oligonucleotide
gaauacagguuaauaaacaaugagauc

SEQ ID NO: 738 - RNA, 27 nt, Artificial Sequence
  Synthetic Oligonucleotide
agaauacagguuaauaaacaaugagau

SEQ ID NO: 739 - RNA, 27 nt, Artificial Sequence
  Synthetic Oligonucleotide
cagaauacagguuaauaaacaaugaga

SEQ ID NO: 740 - RNA, 27 nt, Artificial Sequence
  Synthetic Oligonucleotide
acagaauacagguuaauaaacaaugag

SEQ ID NO: 741 - RNA, 27 nt, Artificial Sequence
  Synthetic Oligonucleotide
aacagaauacagguuaauaaacaauga

SEQ ID NO: 742 - RNA, 27 nt, Artificial Sequence
  Synthetic Oligonucleotide
guaaacagaauacagguuaauaaacaa

SEQ ID NO: 743 - RNA, 27 nt, Artificial Sequence
  Synthetic Oligonucleotide
uguaaacagaauacagguuaauaaaca

SEQ ID NO: 744 - RNA, 27 nt, Artificial Sequence
  Synthetic Oligonucleotide
acauguaaacagaauacagguuaauaa

SEQ ID NO: 745 - RNA, 27 nt, Artificial Sequence
  Synthetic Oligonucleotide
gacauguaaacagaauacagguuaaua

SEQ ID NO: 746 - RNA, 27 nt, Artificial Sequence
  Synthetic Oligonucleotide
uacaauuuaagaaccacuguuuuaaag

SEQ ID NO: 747 - RNA, 27 nt, Artificial Sequence
  Synthetic Oligonucleotide
uuacaauuuaagaaccacuguuuuaaa

SEQ ID NO: 748 - RNA, 27 nt, Artificial Sequence
  Synthetic Oligonucleotide
cuuacaauuuaagaaccacuguuuuaa

SEQ ID NO: 749 - RNA, 27 nt, Artificial Sequence
  Synthetic Oligonucleotide
gcuuacaauuuaagaaccacuguuuua

SEQ ID NO: 750 - RNA, 27 nt, Artificial Sequence
  Synthetic Oligonucleotide
agcuuacaauuuaagaaccacuguuuu

SEQ ID NO: 751 - RNA, 27 nt, Artificial Sequence
  Synthetic Oligonucleotide
gagcuuacaauuuaagaaccacuguuu

SEQ ID NO: 752 - RNA, 27 nt, Artificial Sequence
  Synthetic Oligonucleotide
ugagcuuacaauuuaagaaccacuguu

SEQ ID NO: 753 - RNA, 27 nt, Artificial Sequence
  Synthetic Oligonucleotide
gaaccugagcuuacaauuuaagaacca

SEQ ID NO: 754 - RNA, 27 nt, Artificial Sequence
  Synthetic Oligonucleotide
uuugaaccugagcuuacaauuuaagaa

SEQ ID NO: 755 - RNA, 27 nt, Artificial Sequence
  Synthetic Oligonucleotide
cuuugaaccugagcuuacaauuuaaga

SEQ ID NO: 756 - RNA, 27 nt, Artificial Sequence
  Synthetic Oligonucleotide
cacuuugaaccugagcuuacaauuuaa

SEQ ID NO: 757 - RNA, 27 nt, Artificial Sequence
  Synthetic Oligonucleotide
acacuuugaaccugagcuuacaauuua

SEQ ID NO: 758 - RNA, 27 nt, Artificial Sequence
  Synthetic Oligonucleotide
aacacuuugaaccugagcuuacaauuu

SEQ ID NO: 759 - RNA, 27 nt, Artificial Sequence
  Synthetic Oligonucleotide
aaucuacauucaaagaaguaucaccaa

SEQ ID NO: 760 - RNA, 27 nt, Artificial Sequence
  Synthetic Oligonucleotide
uauauucagacacuaaagaugugauug

SEQ ID NO: 761 - RNA, 27 nt, Artificial Sequence
  Synthetic Oligonucleotide
aacauuuggauauauucagacacuaaa

SEQ ID NO: 762 - RNA, 27 nt, Artificial Sequence
  Synthetic Oligonucleotide
aaacauuuggauauauucagacacuaa

SEQ ID NO: 763 - RNA, 27 nt, Artificial Sequence
  Synthetic Oligonucleotide
aaaacauuuggauauauucagacacua

SEQ ID NO: 764 - RNA, 27 nt, Artificial Sequence
  Synthetic Oligonucleotide
cuaaaacauuuggauauauucagacac

SEQ ID NO: 765 - RNA, 27 nt, Artificial Sequence
  Synthetic Oligonucleotide
ccuaaaacauuuggauauauucagaca

SEQ ID NO: 766 - RNA, 27 nt, Artificial Sequence
  Synthetic Oligonucleotide
uccuaaaacauuuggauauauucagac

SEQ ID NO: 767 - RNA, 27 nt, Artificial Sequence
  Synthetic Oligonucleotide
auccuaaaacauuuggauauauucaga

SEQ ID NO: 768 - RNA, 27 nt, Artificial Sequence
  Synthetic Oligonucleotide
cauccuaaaacauuuggauauauucag

SEQ ID NO: 769 - DNA, 27 bp, Artificial Sequence
  Synthetic Oligonucleotide
ccggctaatttgtatcaatgattatga

SEQ ID NO: 770 - DNA, 27 bp, Artificial Sequence
  Synthetic Oligonucleotide
cggctaatttgtatcaatgattatgaa

SEQ ID NO: 771 - DNA, 27 bp, Artificial Sequence
  Synthetic Oligonucleotide
ggctaatttgtatcaatgattatgaac

SEQ ID NO: 772 - DNA, 27 bp, Artificial Sequence
  Synthetic Oligonucleotide
gctaatttgtatcaatgattatgaaca

SEQ ID NO: 773 - DNA, 27 bp, Artificial Sequence
  Synthetic Oligonucleotide
ctaatttgtatcaatgattatgaacaa

SEQ ID NO: 774 - DNA, 27 bp, Artificial Sequence
  Synthetic Oligonucleotide
taatttgtatcaatgattatgaacaac

SEQ ID NO: 775 - DNA, 27 bp, Artificial Sequence
  Synthetic Oligonucleotide
aatttgtatcaatgattatgaacaaca

SEQ ID NO: 776 - DNA, 27 bp, Artificial Sequence
  Synthetic Oligonucleotide
atttgtatcaatgattatgaacaacat

SEQ ID NO: 777 - DNA, 27 bp, Artificial Sequence
  Synthetic Oligonucleotide
tttgtatcaatgattatgaacaacatg

SEQ ID NO: 778 - DNA, 27 bp, Artificial Sequence
  Synthetic Oligonucleotide
ttgtatcaatgattatgaacaacatgc

SEQ ID NO: 779 - DNA, 27 bp, Artificial Sequence
  Synthetic Oligonucleotide
gtatcaatgattatgaacaacatgcta

SEQ ID NO: 780 - DNA, 27 bp, Artificial Sequence
  Synthetic Oligonucleotide
tatcaatgattatgaacaacatgctaa

SEQ ID NO: 781 - DNA, 27 bp, Artificial Sequence
  Synthetic Oligonucleotide
atcaatgattatgaacaacatgctaaa

SEQ ID NO: 782 - DNA, 27 bp, Artificial Sequence
  Synthetic Oligonucleotide
tcaatgattatgaacaacatgctaaat

SEQ ID NO: 783 - DNA, 27 bp, Artificial Sequence
  Synthetic Oligonucleotide
caatgattatgaacaacatgctaaatc

SEQ ID NO: 784 - DNA, 27 bp, Artificial Sequence
  Synthetic Oligonucleotide
aatgattatgaacaacatgctaaatca

SEQ ID NO: 785 - DNA, 27 bp, Artificial Sequence
  Synthetic Oligonucleotide
atgattatgaacaacatgctaaatcag

SEQ ID NO: 786 - DNA, 27 bp, Artificial Sequence
  Synthetic Oligonucleotide
tgattatgaacaacatgctaaatcagt

SEQ ID NO: 787 - DNA, 27 bp, Artificial Sequence
  Synthetic Oligonucleotide
ttatgaacaacatgctaaatcagtact

SEQ ID NO: 788 - DNA, 27 bp, Artificial Sequence
  Synthetic Oligonucleotide
atgaacaacatgctaaatcagtacttc

SEQ ID NO: 789 - DNA, 27 bp, Artificial Sequence
  Synthetic Oligonucleotide
tgaacaacatgctaaatcagtacttcc

SEQ ID NO: 790 - DNA, 27 bp, Artificial Sequence
  Synthetic Oligonucleotide
acaacatgctaaatcagtacttccaaa

SEQ ID NO: 791 - DNA, 27 bp, Artificial Sequence
  Synthetic Oligonucleotide
taaatcagtacttccaaagtctatata

SEQ ID NO: 792 - DNA, 27 bp, Artificial Sequence
  Synthetic Oligonucleotide
aaatcagtacttccaaagtctatatat

SEQ ID NO: 793 - DNA, 27 bp, Artificial Sequence
  Synthetic Oligonucleotide
atcagtacttccaaagtctatatatga

SEQ ID NO: 794 - DNA, 27 bp, Artificial Sequence
  Synthetic Oligonucleotide
tcagtacttccaaagtctatatatgac

SEQ ID NO: 795 - DNA, 27 bp, Artificial Sequence
  Synthetic Oligonucleotide
cagtacttccaaagtctatatatgact

SEQ ID NO: 796 - DNA, 27 bp, Artificial Sequence
  Synthetic Oligonucleotide
tacttccaaagtctatatatgactatt

SEQ ID NO: 797 - DNA, 27 bp, Artificial Sequence
  Synthetic Oligonucleotide
ttccaaagtctatatatgactattaca

SEQ ID NO: 798 - DNA, 27 bp, Artificial Sequence
  Synthetic Oligonucleotide
tccaaagtctatatatgactattacag

SEQ ID NO: 799 - DNA, 27 bp, Artificial Sequence
  Synthetic Oligonucleotide
caaagtctatatatgactattacaggt

SEQ ID NO: 800 - DNA, 27 bp, Artificial Sequence
  Synthetic Oligonucleotide
tatatgactattacaggtctggggcaa

SEQ ID NO: 801 - DNA, 27 bp, Artificial Sequence
  Synthetic Oligonucleotide
atatgactattacaggtctggggcaaa

SEQ ID NO: 802 - DNA, 27 bp, Artificial Sequence
  Synthetic Oligonucleotide
tatgactattacaggtctggggcaaat

SEQ ID NO: 803 - DNA, 27 bp, Artificial Sequence
  Synthetic Oligonucleotide
atgactattacaggtctggggcaaatg

SEQ ID NO: 804 - DNA, 27 bp, Artificial Sequence
  Synthetic Oligonucleotide
tgactattacaggtctggggcaaatga

SEQ ID NO: 805 - DNA, 27 bp, Artificial Sequence
  Synthetic Oligonucleotide
gactattacaggtctggggcaaatgat

SEQ ID NO: 806 - DNA, 27 bp, Artificial Sequence
  Synthetic Oligonucleotide
actattacaggtctggggcaaatgatg

SEQ ID NO: 807 - DNA, 27 bp, Artificial Sequence
  Synthetic Oligonucleotide
ctattacaggtctggggcaaatgatga

SEQ ID NO: 808 - DNA, 27 bp, Artificial Sequence
  Synthetic Oligonucleotide
tattacaggtctggggcaaatgatgaa

SEQ ID NO: 809 - DNA, 27 bp, Artificial Sequence
  Synthetic Oligonucleotide
attacaggtctggggcaaatgatgaag

SEQ ID NO: 810 - DNA, 27 bp, Artificial Sequence
  Synthetic Oligonucleotide
ttacaggtctggggcaaatgatgaaga

SEQ ID NO: 811 - DNA, 27 bp, Artificial Sequence
  Synthetic Oligonucleotide
tacaggtctggggcaaatgatgaagaa

SEQ ID NO: 812 - DNA, 27 bp, Artificial Sequence
  Synthetic Oligonucleotide
ccggaatgttgctgaaacagatctgtc

SEQ ID NO: 813 - DNA, 27 bp, Artificial Sequence
  Synthetic Oligonucleotide
cgacttctgttttaggacagagggtca

SEQ ID NO: 814 - DNA, 27 bp, Artificial Sequence
  Synthetic Oligonucleotide
gacttctgttttaggacagagggtcag

SEQ ID NO: 815 - DNA, 27 bp, Artificial Sequence
  Synthetic Oligonucleotide
gctacaaggccatatttgtgacagtgg

SEQ ID NO: 816 - DNA, 27 bp, Artificial Sequence
  Synthetic Oligonucleotide
ctacaaggccatatttgtgacagtgga

SEQ ID NO: 817 - DNA, 27 bp, Artificial Sequence
  Synthetic Oligonucleotide
cgccacaactcaggatgaaaaattttg

SEQ ID NO: 818 - DNA, 27 bp, Artificial Sequence
  Synthetic Oligonucleotide
gccacaactcaggatgaaaaattttga

SEQ ID NO: 819 - DNA, 27 bp, Artificial Sequence
  Synthetic Oligonucleotide
ccacaactcaggatgaaaaattttgaa

SEQ ID NO: 820 - DNA, 27 bp, Artificial Sequence
  Synthetic Oligonucleotide
cacaactcaggatgaaaaattttgaaa

SEQ ID NO: 821 - DNA, 27 bp, Artificial Sequence
  Synthetic Oligonucleotide
acaactcaggatgaaaaattttgaaac

SEQ ID NO: 822 - DNA, 27 bp, Artificial Sequence
  Synthetic Oligonucleotide
aactcaggatgaaaaattttgaaacca

SEQ ID NO: 823 - DNA, 27 bp, Artificial Sequence
  Synthetic Oligonucleotide
actcaggatgaaaaattttgaaaccag

SEQ ID NO: 824 - DNA, 27 bp, Artificial Sequence
  Synthetic Oligonucleotide
ctcaggatgaaaaattttgaaaccagt

SEQ ID NO: 825 - DNA, 27 bp, Artificial Sequence
  Synthetic Oligonucleotide
tcaggatgaaaaattttgaaaccagta

SEQ ID NO: 826 - DNA, 27 bp, Artificial Sequence
  Synthetic Oligonucleotide
aggatgaaaaattttgaaaccagtact

SEQ ID NO: 827 - DNA, 27 bp, Artificial Sequence
  Synthetic Oligonucleotide
ggatgaaaaattttgaaaccagtactt

SEQ ID NO: 828 - DNA, 27 bp, Artificial Sequence
  Synthetic Oligonucleotide
gatgaaaaattttgaaaccagtacttt

SEQ ID NO: 829 - DNA, 27 bp, Artificial Sequence
  Synthetic Oligonucleotide
atgaaaaattttgaaaccagtacttta

SEQ ID NO: 830 - DNA, 27 bp, Artificial Sequence
  Synthetic Oligonucleotide
tgaaaaattttgaaaccagtactttat

SEQ ID NO: 831 - DNA, 27 bp, Artificial Sequence
  Synthetic Oligonucleotide
gaaaaattttgaaaccagtactttatc

SEQ ID NO: 832 - DNA, 27 bp, Artificial Sequence
  Synthetic Oligonucleotide
aaaaattttgaaaccagtactttatca

SEQ ID NO: 833 - DNA, 27 bp, Artificial Sequence
  Synthetic Oligonucleotide
aaaattttgaaaccagtactttatcat

SEQ ID NO: 834 - DNA, 27 bp, Artificial Sequence
  Synthetic Oligonucleotide
aaattttgaaaccagtactttatcatt

SEQ ID NO: 835 - DNA, 27 bp, Artificial Sequence
  Synthetic Oligonucleotide
aattttgaaaccagtactttatcattt

SEQ ID NO: 836 - DNA, 27 bp, Artificial Sequence
  Synthetic Oligonucleotide
attttgaaaccagtactttatcatttt

SEQ ID NO: 837 - DNA, 27 bp, Artificial Sequence
  Synthetic Oligonucleotide
ttttgaaaccagtactttatcattttc

SEQ ID NO: 838 - DNA, 27 bp, Artificial Sequence
  Synthetic Oligonucleotide
tttgaaaccagtactttatcattttct

SEQ ID NO: 839 - DNA, 27 bp, Artificial Sequence
  Synthetic Oligonucleotide
ttgaaaccagtactttatcattttctc

SEQ ID NO: 840 - DNA, 27 bp, Artificial Sequence
  Synthetic Oligonucleotide
tgaaaccagtactttatcattttctcc

SEQ ID NO: 841 - DNA, 27 bp, Artificial Sequence
  Synthetic Oligonucleotide
gaaaccagtactttatcattttctcct

SEQ ID NO: 842 - DNA, 27 bp, Artificial Sequence
  Synthetic Oligonucleotide
aaccagtactttatcattttctcctga

SEQ ID NO: 843 - DNA, 27 bp, Artificial Sequence
  Synthetic Oligonucleotide
accagtactttatcattttctcctgag

SEQ ID NO: 844 - DNA, 27 bp, Artificial Sequence
  Synthetic Oligonucleotide
ttatcattttctcctgaggaaaatttt

SEQ ID NO: 845 - DNA, 27 bp, Artificial Sequence
  Synthetic Oligonucleotide
caaatggctgagaagactgacatcatt

SEQ ID NO: 846 - DNA, 27 bp, Artificial Sequence
  Synthetic Oligonucleotide
gcaaagggcattttgagaggtgatgat

SEQ ID NO: 847 - DNA, 27 bp, Artificial Sequence
  Synthetic Oligonucleotide
caaagggcattttgagaggtgatgatg

SEQ ID NO: 848 - DNA, 27 bp, Artificial Sequence
  Synthetic Oligonucleotide
aaagggcattttgagaggtgatgatgc

SEQ ID NO: 849 - DNA, 27 bp, Artificial Sequence
  Synthetic Oligonucleotide
aagggcattttgagaggtgatgatgcc

SEQ ID NO: 850 - DNA, 27 bp, Artificial Sequence
  Synthetic Oligonucleotide
agggcattttgagaggtgatgatgcca

SEQ ID NO: 851 - DNA, 27 bp, Artificial Sequence
  Synthetic Oligonucleotide
gggcattttgagaggtgatgatgccag

SEQ ID NO: 852 - DNA, 27 bp, Artificial Sequence
  Synthetic Oligonucleotide
ggcattttgagaggtgatgatgccagg

SEQ ID NO: 853 - DNA, 27 bp, Artificial Sequence
  Synthetic Oligonucleotide
gcattttgagaggtgatgatgccaggg

SEQ ID NO: 854 - DNA, 27 bp, Artificial Sequence
  Synthetic Oligonucleotide
cattttgagaggtgatgatgccaggga

SEQ ID NO: 855 - DNA, 27 bp, Artificial Sequence
  Synthetic Oligonucleotide
attttgagaggtgatgatgccagggag

SEQ ID NO: 856 - DNA, 27 bp, Artificial Sequence
  Synthetic Oligonucleotide
ttttgagaggtgatgatgccagggagg

SEQ ID NO: 857 - DNA, 27 bp, Artificial Sequence
  Synthetic Oligonucleotide
gaatgggatcttggtgtcgaatcatgg

SEQ ID NO: 858 - DNA, 27 bp, Artificial Sequence
  Synthetic Oligonucleotide
aatgggatcttggtgtcgaatcatggg

SEQ ID NO: 859 - DNA, 27 bp, Artificial Sequence
  Synthetic Oligonucleotide
atgggatcttggtgtcgaatcatgggg

SEQ ID NO: 860 - DNA, 27 bp, Artificial Sequence
  Synthetic Oligonucleotide
tgggatcttggtgtcgaatcatggggc

SEQ ID NO: 861 - DNA, 27 bp, Artificial Sequence
  Synthetic Oligonucleotide
gggatcttggtgtcgaatcatggggct

SEQ ID NO: 862 - DNA, 27 bp, Artificial Sequence
  Synthetic Oligonucleotide
ggatcttggtgtcgaatcatggggctc

SEQ ID NO: 863 - DNA, 27 bp, Artificial Sequence
  Synthetic Oligonucleotide
gatcttggtgtcgaatcatggggctcg

SEQ ID NO: 864 - DNA, 27 bp, Artificial Sequence
  Synthetic Oligonucleotide
atcttggtgtcgaatcatggggctcga

SEQ ID NO: 865 - DNA, 27 bp, Artificial Sequence
  Synthetic Oligonucleotide
tcttggtgtcgaatcatggggctcgac

SEQ ID NO: 866 - DNA, 27 bp, Artificial Sequence
  Synthetic Oligonucleotide
cttggtgtcgaatcatggggctcgaca

SEQ ID NO: 867 - DNA, 27 bp, Artificial Sequence
  Synthetic Oligonucleotide
agccactattgatgttctgccagaaat

SEQ ID NO: 868 - DNA, 27 bp, Artificial Sequence
  Synthetic Oligonucleotide
cactattgatgttctgccagaaattgt

SEQ ID NO: 869 - DNA, 27 bp, Artificial Sequence
  Synthetic Oligonucleotide
actattgatgttctgccagaaattgtg

SEQ ID NO: 870 - DNA, 27 bp, Artificial Sequence
  Synthetic Oligonucleotide
tggaggctgtggaagggaaggtggaag

SEQ ID NO: 871 - DNA, 27 bp, Artificial Sequence
  Synthetic Oligonucleotide
ggaggctgtggaagggaaggtggaagt

SEQ ID NO: 872 - DNA, 27 bp, Artificial Sequence
  Synthetic Oligonucleotide
ggggagaaaggtgttcaagatgtcctc

SEQ ID NO: 873 - DNA, 27 bp, Artificial Sequence
  Synthetic Oligonucleotide
gggagaaaggtgttcaagatgtcctcg

SEQ ID NO: 874 - DNA, 27 bp, Artificial Sequence
  Synthetic Oligonucleotide
ggagaaaggtgttcaagatgtcctcga

SEQ ID NO: 875 - DNA, 27 bp, Artificial Sequence
  Synthetic Oligonucleotide
gagaaaggtgttcaagatgtcctcgag

SEQ ID NO: 876 - DNA, 27 bp, Artificial Sequence
  Synthetic Oligonucleotide
agaaaggtgttcaagatgtcctcgaga

SEQ ID NO: 877 - DNA, 27 bp, Artificial Sequence
  Synthetic Oligonucleotide
gaaaggtgttcaagatgtcctcgagat

SEQ ID NO: 878 - DNA, 27 bp, Artificial Sequence
  Synthetic Oligonucleotide
aaaggtgttcaagatgtcctcgagata

SEQ ID NO: 879 - DNA, 27 bp, Artificial Sequence
  Synthetic Oligonucleotide
aaggtgttcaagatgtcctcgagatac

SEQ ID NO: 880 - DNA, 27 bp, Artificial Sequence
  Synthetic Oligonucleotide
aggtgttcaagatgtcctcgagatact

SEQ ID NO: 881 - DNA, 27 bp, Artificial Sequence
  Synthetic Oligonucleotide
ggtgttcaagatgtcctcgagatacta

SEQ ID NO: 882 - DNA, 27 bp, Artificial Sequence
  Synthetic Oligonucleotide
gtgttcaagatgtcctcgagatactaa

SEQ ID NO: 883 - DNA, 27 bp, Artificial Sequence
  Synthetic Oligonucleotide
tgttcaagatgtcctcgagatactaaa

SEQ ID NO: 884 - DNA, 27 bp, Artificial Sequence
  Synthetic Oligonucleotide
gttcaagatgtcctcgagatactaaag

SEQ ID NO: 885 - DNA, 27 bp, Artificial Sequence
  Synthetic Oligonucleotide
gttggccatggctctgagtgggtgcca

SEQ ID NO: 886 - DNA, 27 bp, Artificial Sequence
  Synthetic Oligonucleotide
ttggccatggctctgagtgggtgccag

SEQ ID NO: 887 - DNA, 27 bp, Artificial Sequence
  Synthetic Oligonucleotide
tggccatggctctgagtgggtgccaga

SEQ ID NO: 888 - DNA, 27 bp, Artificial Sequence
  Synthetic Oligonucleotide
ggccatggctctgagtgggtgccagaa

SEQ ID NO: 889 - DNA, 27 bp, Artificial Sequence
  Synthetic Oligonucleotide
gccatggctctgagtgggtgccagaat

SEQ ID NO: 890 - DNA, 27 bp, Artificial Sequence
  Synthetic Oligonucleotide
ccatggctctgagtgggtgccagaatg

SEQ ID NO: 891 - DNA, 27 bp, Artificial Sequence
  Synthetic Oligonucleotide
catggctctgagtgggtgccagaatgt

SEQ ID NO: 892 - DNA, 27 bp, Artificial Sequence
  Synthetic Oligonucleotide
atggctctgagtgggtgccagaatgtg

SEQ ID NO: 893 - DNA, 27 bp, Artificial Sequence
  Synthetic Oligonucleotide
tggctctgagtgggtgccagaatgtga

SEQ ID NO: 894 - DNA, 27 bp, Artificial Sequence
  Synthetic Oligonucleotide
ggctctgagtgggtgccagaatgtgaa

SEQ ID NO: 895 - DNA, 27 bp, Artificial Sequence
  Synthetic Oligonucleotide
gctctgagtgggtgccagaatgtgaaa

SEQ ID NO: 896 - DNA, 27 bp, Artificial Sequence
  Synthetic Oligonucleotide
ctctgagtgggtgccagaatgtgaaag

SEQ ID NO: 897 - DNA, 27 bp, Artificial Sequence
  Synthetic Oligonucleotide
tctgagtgggtgccagaatgtgaaagt

SEQ ID NO: 898 - DNA, 27 bp, Artificial Sequence
  Synthetic Oligonucleotide
ctgagtgggtgccagaatgtgaaagtc

SEQ ID NO: 899 - DNA, 27 bp, Artificial Sequence
  Synthetic Oligonucleotide
tgagtgggtgccagaatgtgaaagtca

SEQ ID NO: 900 - DNA, 27 bp, Artificial Sequence
  Synthetic Oligonucleotide
gagtgggtgccagaatgtgaaagtcat

SEQ ID NO: 901 - DNA, 27 bp, Artificial Sequence
  Synthetic Oligonucleotide
agtgggtgccagaatgtgaaagtcatc

SEQ ID NO: 902 - DNA, 27 bp, Artificial Sequence
  Synthetic Oligonucleotide
gtgggtgccagaatgtgaaagtcatcg

SEQ ID NO: 903 - DNA, 27 bp, Artificial Sequence
  Synthetic Oligonucleotide
tgggtgccagaatgtgaaagtcatcga

SEQ ID NO: 904 - DNA, 27 bp, Artificial Sequence
  Synthetic Oligonucleotide
gggtgccagaatgtgaaagtcatcgac

SEQ ID NO: 905 - DNA, 27 bp, Artificial Sequence
  Synthetic Oligonucleotide
ggtgccagaatgtgaaagtcatcgaca

SEQ ID NO: 906 - DNA, 27 bp, Artificial Sequence
  Synthetic Oligonucleotide
gtgccagaatgtgaaagtcatcgacaa

SEQ ID NO: 907 - DNA, 27 bp, Artificial Sequence
  Synthetic Oligonucleotide
tgccagaatgtgaaagtcatcgacaag

SEQ ID NO: 908 - DNA, 27 bp, Artificial Sequence
  Synthetic Oligonucleotide
gccagaatgtgaaagtcatcgacaaga

SEQ ID NO: 909 - DNA, 27 bp, Artificial Sequence
  Synthetic Oligonucleotide
ccagaatgtgaaagtcatcgacaagac

SEQ ID NO: 910 - DNA, 27 bp, Artificial Sequence
  Synthetic Oligonucleotide
cagaatgtgaaagtcatcgacaagaca

SEQ ID NO: 911 - DNA, 27 bp, Artificial Sequence
  Synthetic Oligonucleotide
agaatgtgaaagtcatcgacaagacat

SEQ ID NO: 912 - DNA, 27 bp, Artificial Sequence
  Synthetic Oligonucleotide
gaatgtgaaagtcatcgacaagacatt

SEQ ID NO: 913 - DNA, 27 bp, Artificial Sequence
  Synthetic Oligonucleotide
aatgtgaaagtcatcgacaagacattg

SEQ ID NO: 914 - DNA, 27 bp, Artificial Sequence
  Synthetic Oligonucleotide
atgtgaaagtcatcgacaagacattgg

SEQ ID NO: 915 - DNA, 27 bp, Artificial Sequence
  Synthetic Oligonucleotide
tgtgaaagtcatcgacaagacattggt

SEQ ID NO: 916 - DNA, 27 bp, Artificial Sequence
  Synthetic Oligonucleotide
gtgaaagtcatcgacaagacattggtg

SEQ ID NO: 917 - DNA, 27 bp, Artificial Sequence
  Synthetic Oligonucleotide
tgaaagtcatcgacaagacattggtga

SEQ ID NO: 918 - DNA, 27 bp, Artificial Sequence
  Synthetic Oligonucleotide
gaaagtcatcgacaagacattggtgag

SEQ ID NO: 919 - DNA, 27 bp, Artificial Sequence
  Synthetic Oligonucleotide
aaagtcatcgacaagacattggtgagg

SEQ ID NO: 920 - DNA, 27 bp, Artificial Sequence
  Synthetic Oligonucleotide
aagtcatcgacaagacattggtgagga

SEQ ID NO: 921 - DNA, 27 bp, Artificial Sequence
  Synthetic Oligonucleotide
agtcatcgacaagacattggtgaggaa

SEQ ID NO: 922 - DNA, 27 bp, Artificial Sequence
  Synthetic Oligonucleotide
gtcatcgacaagacattggtgaggaaa

SEQ ID NO: 923 - DNA, 27 bp, Artificial Sequence
  Synthetic Oligonucleotide
tcatcgacaagacattggtgaggaaaa

SEQ ID NO: 924 - DNA, 27 bp, Artificial Sequence
  Synthetic Oligonucleotide
catcgacaagacattggtgaggaaaaa

SEQ ID NO: 925 - DNA, 27 bp, Artificial Sequence
  Synthetic Oligonucleotide
atcgacaagacattggtgaggaaaaat

SEQ ID NO: 926 - DNA, 27 bp, Artificial Sequence
  Synthetic Oligonucleotide
tcgacaagacattggtgaggaaaaatc

SEQ ID NO: 927 - DNA, 27 bp, Artificial Sequence
  Synthetic Oligonucleotide
cgacaagacattggtgaggaaaaatcc

SEQ ID NO: 928 - DNA, 27 bp, Artificial Sequence
  Synthetic Oligonucleotide
gacaagacattggtgaggaaaaatcct

SEQ ID NO: 929 - DNA, 27 bp, Artificial Sequence
  Synthetic Oligonucleotide
acaagacattggtgaggaaaaatcctt

SEQ ID NO: 930 - DNA, 27 bp, Artificial Sequence
  Synthetic Oligonucleotide
caagacattggtgaggaaaaatccttt

SEQ ID NO: 931 - DNA, 27 bp, Artificial Sequence
  Synthetic Oligonucleotide
aagacattggtgaggaaaaatcctttg

SEQ ID NO: 932 - DNA, 27 bp, Artificial Sequence
  Synthetic Oligonucleotide
agacattggtgaggaaaaatcctttgg

SEQ ID NO: 933 - DNA, 27 bp, Artificial Sequence
  Synthetic Oligonucleotide
gacattggtgaggaaaaatcctttggc

SEQ ID NO: 934 - DNA, 27 bp, Artificial Sequence
  Synthetic Oligonucleotide
acattggtgaggaaaaatcctttggcc

SEQ ID NO: 935 - DNA, 27 bp, Artificial Sequence
  Synthetic Oligonucleotide
cattggtgaggaaaaatcctttggccg

SEQ ID NO: 936 - DNA, 27 bp, Artificial Sequence
  Synthetic Oligonucleotide
attggtgaggaaaaatcctttggccgt

SEQ ID NO: 937 - DNA, 27 bp, Artificial Sequence
  Synthetic Oligonucleotide
ttggtgaggaaaaatcctttggccgtt

SEQ ID NO: 938 - DNA, 27 bp, Artificial Sequence
  Synthetic Oligonucleotide
tggtgaggaaaaatcctttggccgttt

SEQ ID NO: 939 - DNA, 27 bp, Artificial Sequence
  Synthetic Oligonucleotide
ggtgaggaaaaatcctttggccgtttc

SEQ ID NO: 940 - DNA, 27 bp, Artificial Sequence
  Synthetic Oligonucleotide
ccgtttccaagatctgacagtgcacaa

SEQ ID NO: 941 - DNA, 27 bp, Artificial Sequence
  Synthetic Oligonucleotide
cgtttccaagatctgacagtgcacaat

SEQ ID NO: 942 - DNA, 27 bp, Artificial Sequence
  Synthetic Oligonucleotide
gtttccaagatctgacagtgcacaata

SEQ ID NO: 943 - DNA, 27 bp, Artificial Sequence
  Synthetic Oligonucleotide
tttccaagatctgacagtgcacaatat

SEQ ID NO: 944 - DNA, 27 bp, Artificial Sequence
  Synthetic Oligonucleotide
ttccaagatctgacagtgcacaatatt

SEQ ID NO: 945 - DNA, 27 bp, Artificial Sequence
  Synthetic Oligonucleotide
tccaagatctgacagtgcacaatattt

SEQ ID NO: 946 - DNA, 27 bp, Artificial Sequence
  Synthetic Oligonucleotide
ccaagatctgacagtgcacaatatttt

SEQ ID NO: 947 - DNA, 27 bp, Artificial Sequence
  Synthetic Oligonucleotide
caagatctgacagtgcacaatattttc

SEQ ID NO: 948 - DNA, 27 bp, Artificial Sequence
  Synthetic Oligonucleotide
aagatctgacagtgcacaatattttcc

SEQ ID NO: 949 - DNA, 27 bp, Artificial Sequence
  Synthetic Oligonucleotide
agatctgacagtgcacaatattttccc

SEQ ID NO: 950 - DNA, 27 bp, Artificial Sequence
  Synthetic Oligonucleotide
gatctgacagtgcacaatattttccca

SEQ ID NO: 951 - DNA, 27 bp, Artificial Sequence
  Synthetic Oligonucleotide
atctgacagtgcacaatattttcccat

SEQ ID NO: 952 - DNA, 27 bp, Artificial Sequence
  Synthetic Oligonucleotide
tctgacagtgcacaatattttcccatc

SEQ ID NO: 953 - DNA, 27 bp, Artificial Sequence
  Synthetic Oligonucleotide
ctgacagtgcacaatattttcccatct

SEQ ID NO: 954 - DNA, 27 bp, Artificial Sequence
  Synthetic Oligonucleotide
tgacagtgcacaatattttcccatctg

SEQ ID NO: 955 - DNA, 27 bp, Artificial Sequence
  Synthetic Oligonucleotide
gacagtgcacaatattttcccatctgt

SEQ ID NO: 956 - DNA, 27 bp, Artificial Sequence
  Synthetic Oligonucleotide
acagtgcacaatattttcccatctgta

SEQ ID NO: 957 - DNA, 27 bp, Artificial Sequence
  Synthetic Oligonucleotide
cagtgcacaatattttcccatctgtat

SEQ ID NO: 958 - DNA, 27 bp, Artificial Sequence
  Synthetic Oligonucleotide
agtgcacaatattttcccatctgtatt

SEQ ID NO: 959 - DNA, 27 bp, Artificial Sequence
  Synthetic Oligonucleotide
gtgcacaatattttcccatctgtatta

SEQ ID NO: 960 - DNA, 27 bp, Artificial Sequence
  Synthetic Oligonucleotide
tgcacaatattttcccatctgtattat

SEQ ID NO: 961 - DNA, 27 bp, Artificial Sequence
  Synthetic Oligonucleotide
gcacaatattttcccatctgtattatt

SEQ ID NO: 962 - DNA, 27 bp, Artificial Sequence
  Synthetic Oligonucleotide
cacaatattttcccatctgtattattt

SEQ ID NO: 963 - DNA, 27 bp, Artificial Sequence
  Synthetic Oligonucleotide
acaatattttcccatctgtattatttt

SEQ ID NO: 964 - DNA, 27 bp, Artificial Sequence
  Synthetic Oligonucleotide
caatattttcccatctgtattattttt

SEQ ID NO: 965 - DNA, 27 bp, Artificial Sequence
  Synthetic Oligonucleotide
aatattttcccatctgtattatttttt

SEQ ID NO: 966 - DNA, 27 bp, Artificial Sequence
  Synthetic Oligonucleotide
atattttcccatctgtattattttttt

SEQ ID NO: 967 - DNA, 27 bp, Artificial Sequence
  Synthetic Oligonucleotide
tttttttcagcatgtattacttgacaa

SEQ ID NO: 968 - DNA, 27 bp, Artificial Sequence
  Synthetic Oligonucleotide
ttttttcagcatgtattacttgacaaa

SEQ ID NO: 969 - DNA, 27 bp, Artificial Sequence
  Synthetic Oligonucleotide
tttttcagcatgtattacttgacaaag

SEQ ID NO: 970 - DNA, 27 bp, Artificial Sequence
  Synthetic Oligonucleotide
ttttcagcatgtattacttgacaaaga

SEQ ID NO: 971 - DNA, 27 bp, Artificial Sequence
  Synthetic Oligonucleotide
tttcagcatgtattacttgacaaagag

SEQ ID NO: 972 - DNA, 27 bp, Artificial Sequence
  Synthetic Oligonucleotide
ttcagcatgtattacttgacaaagaga

SEQ ID NO: 973 - DNA, 27 bp, Artificial Sequence
  Synthetic Oligonucleotide
tcagcatgtattacttgacaaagagac

SEQ ID NO: 974 - DNA, 27 bp, Artificial Sequence
  Synthetic Oligonucleotide
cagcatgtattacttgacaaagagaca

SEQ ID NO: 975 - DNA, 27 bp, Artificial Sequence
  Synthetic Oligonucleotide
agcatgtattacttgacaaagagacac

SEQ ID NO: 976 - DNA, 27 bp, Artificial Sequence
  Synthetic Oligonucleotide
tgtattacttgacaaagagacactgtg

SEQ ID NO: 977 - DNA, 27 bp, Artificial Sequence
  Synthetic Oligonucleotide
gtattacttgacaaagagacactgtgc

SEQ ID NO: 978 - DNA, 27 bp, Artificial Sequence
  Synthetic Oligonucleotide
tattacttgacaaagagacactgtgca

SEQ ID NO: 979 - DNA, 27 bp, Artificial Sequence
  Synthetic Oligonucleotide
attacttgacaaagagacactgtgcag

SEQ ID NO: 980 - DNA, 27 bp, Artificial Sequence
  Synthetic Oligonucleotide
ttacttgacaaagagacactgtgcaga

SEQ ID NO: 981 - DNA, 27 bp, Artificial Sequence
  Synthetic Oligonucleotide
tacttgacaaagagacactgtgcagag

SEQ ID NO: 982 - DNA, 27 bp, Artificial Sequence
  Synthetic Oligonucleotide
acttgacaaagagacactgtgcagagg

SEQ ID NO: 983 - DNA, 27 bp, Artificial Sequence
  Synthetic Oligonucleotide
cttgacaaagagacactgtgcagaggg

SEQ ID NO: 984 - DNA, 27 bp, Artificial Sequence
  Synthetic Oligonucleotide
ttgacaaagagacactgtgcagagggt

SEQ ID NO: 985 - DNA, 27 bp, Artificial Sequence
  Synthetic Oligonucleotide
tgacaaagagacactgtgcagagggtg

SEQ ID NO: 986 - DNA, 27 bp, Artificial Sequence
  Synthetic Oligonucleotide
gacaaagagacactgtgcagagggtga

SEQ ID NO: 987 - DNA, 27 bp, Artificial Sequence
  Synthetic Oligonucleotide
acaaagagacactgtgcagagggtgac

SEQ ID NO: 988 - DNA, 27 bp, Artificial Sequence
  Synthetic Oligonucleotide
caaagagacactgtgcagagggtgacc

SEQ ID NO: 989 - DNA, 27 bp, Artificial Sequence
  Synthetic Oligonucleotide
aaagagacactgtgcagagggtgacca

SEQ ID NO: 990 - DNA, 27 bp, Artificial Sequence
  Synthetic Oligonucleotide
aagagacactgtgcagagggtgaccac

SEQ ID NO: 991 - DNA, 27 bp, Artificial Sequence
  Synthetic Oligonucleotide
agagacactgtgcagagggtgaccaca

SEQ ID NO: 992 - DNA, 27 bp, Artificial Sequence
  Synthetic Oligonucleotide
gagacactgtgcagagggtgaccacag

SEQ ID NO: 993 - DNA, 27 bp, Artificial Sequence
  Synthetic Oligonucleotide
agacactgtgcagagggtgaccacagt

SEQ ID NO: 994 - DNA, 27 bp, Artificial Sequence
  Synthetic Oligonucleotide
gacactgtgcagagggtgaccacagtc

SEQ ID NO: 995 - DNA, 27 bp, Artificial Sequence
  Synthetic Oligonucleotide
acactgtgcagagggtgaccacagtct

SEQ ID NO: 996 - DNA, 27 bp, Artificial Sequence
  Synthetic Oligonucleotide
cactgtgcagagggtgaccacagtctg

SEQ ID NO: 997 - DNA, 27 bp, Artificial Sequence
  Synthetic Oligonucleotide
actgtgcagagggtgaccacagtctgt

SEQ ID NO: 998 - DNA, 27 bp, Artificial Sequence
  Synthetic Oligonucleotide
ctgtgcagagggtgaccacagtctgta

SEQ ID NO: 999 - DNA, 27 bp, Artificial Sequence
  Synthetic Oligonucleotide
cagtctgtaattccccacttcaataca

SEQ ID NO: 1000 - DNA, 27 bp, Artificial Sequence
  Synthetic Oligonucleotide
agtctgtaattccccacttcaatacaa

SEQ ID NO: 1001 - DNA, 27 bp, Artificial Sequence
  Synthetic Oligonucleotide
gtctgtaattccccacttcaatacaaa

SEQ ID NO: 1002 - DNA, 27 bp, Artificial Sequence
  Synthetic Oligonucleotide
tctgtaattccccacttcaatacaaag

SEQ ID NO: 1003 - DNA, 27 bp, Artificial Sequence
  Synthetic Oligonucleotide
caatacaaagggtgtcgttcttttcca

SEQ ID NO: 1004 - DNA, 27 bp, Artificial Sequence
  Synthetic Oligonucleotide
aatacaaagggtgtcgttcttttccaa

SEQ ID NO: 1005 - DNA, 27 bp, Artificial Sequence
  Synthetic Oligonucleotide
atacaaagggtgtcgttcttttccaac

SEQ ID NO: 1006 - DNA, 27 bp, Artificial Sequence
  Synthetic Oligonucleotide
tacaaagggtgtcgttcttttccaaca

SEQ ID NO: 1007 - DNA, 27 bp, Artificial Sequence
  Synthetic Oligonucleotide
acaaagggtgtcgttcttttccaacaa

SEQ ID NO: 1008 - DNA, 27 bp, Artificial Sequence
  Synthetic Oligonucleotide
caaagggtgtcgttcttttccaacaaa

SEQ ID NO: 1009 - DNA, 27 bp, Artificial Sequence
  Synthetic Oligonucleotide
aaagggtgtcgttcttttccaacaaaa

SEQ ID NO: 1010 - DNA, 27 bp, Artificial Sequence
  Synthetic Oligonucleotide
aagggtgtcgttcttttccaacaaaat

SEQ ID NO: 1011 - DNA, 27 bp, Artificial Sequence
  Synthetic Oligonucleotide
agggtgtcgttcttttccaacaaaata

SEQ ID NO: 1012 - DNA, 27 bp, Artificial Sequence
  Synthetic Oligonucleotide
gggtgtcgttcttttccaacaaaatag

SEQ ID NO: 1013 - DNA, 27 bp, Artificial Sequence
  Synthetic Oligonucleotide
ggtgtcgttcttttccaacaaaatagc

SEQ ID NO: 1014 - DNA, 27 bp, Artificial Sequence
  Synthetic Oligonucleotide
gtgtcgttcttttccaacaaaatagca

SEQ ID NO: 1015 - DNA, 27 bp, Artificial Sequence
  Synthetic Oligonucleotide
tgtcgttcttttccaacaaaatagcaa

SEQ ID NO: 1016 - DNA, 27 bp, Artificial Sequence
  Synthetic Oligonucleotide
gtcgttcttttccaacaaaatagcaat

SEQ ID NO: 1017 - DNA, 27 bp, Artificial Sequence
  Synthetic Oligonucleotide
tcgttcttttccaacaaaatagcaatc

SEQ ID NO: 1018 - DNA, 27 bp, Artificial Sequence
  Synthetic Oligonucleotide
cgttcttttccaacaaaatagcaatcc

SEQ ID NO: 1019 - DNA, 27 bp, Artificial Sequence
  Synthetic Oligonucleotide
gttcttttccaacaaaatagcaatccc

SEQ ID NO: 1020 - DNA, 27 bp, Artificial Sequence
  Synthetic Oligonucleotide
tccaacaaaatagcaatcccttttatt

SEQ ID NO: 1021 - DNA, 27 bp, Artificial Sequence
  Synthetic Oligonucleotide
ccaacaaaatagcaatcccttttattt

SEQ ID NO: 1022 - DNA, 27 bp, Artificial Sequence
  Synthetic Oligonucleotide
caacaaaatagcaatcccttttatttc

SEQ ID NO: 1023 - DNA, 27 bp, Artificial Sequence
  Synthetic Oligonucleotide
aacaaaatagcaatcccttttatttca

SEQ ID NO: 1024 - DNA, 27 bp, Artificial Sequence
  Synthetic Oligonucleotide
acaaaatagcaatcccttttatttcat

SEQ ID NO: 1025 - DNA, 27 bp, Artificial Sequence
  Synthetic Oligonucleotide
atttcattgcttttgacttttcaatgg

SEQ ID NO: 1026 - DNA, 27 bp, Artificial Sequence
  Synthetic Oligonucleotide
tttcattgcttttgacttttcaatggg

SEQ ID NO: 1027 - DNA, 27 bp, Artificial Sequence
  Synthetic Oligonucleotide
ttcattgcttttgacttttcaatgggt

SEQ ID NO: 1028 - DNA, 27 bp, Artificial Sequence
  Synthetic Oligonucleotide
tcattgcttttgacttttcaatgggtg

SEQ ID NO: 1029 - DNA, 27 bp, Artificial Sequence
  Synthetic Oligonucleotide
cattgcttttgacttttcaatgggtgt

SEQ ID NO: 1030 - DNA, 27 bp, Artificial Sequence
  Synthetic Oligonucleotide
attgcttttgacttttcaatgggtgtc

SEQ ID NO: 1031 - DNA, 27 bp, Artificial Sequence
  Synthetic Oligonucleotide
ttgcttttgacttttcaatgggtgtcc

SEQ ID NO: 1032 - DNA, 27 bp, Artificial Sequence
  Synthetic Oligonucleotide
tgcttttgacttttcaatgggtgtcct

SEQ ID NO: 1033 - DNA, 27 bp, Artificial Sequence
  Synthetic Oligonucleotide
gcttttgacttttcaatgggtgtccta

SEQ ID NO: 1034 - DNA, 27 bp, Artificial Sequence
  Synthetic Oligonucleotide
cttttgacttttcaatgggtgtcctag

SEQ ID NO: 1035 - DNA, 27 bp, Artificial Sequence
  Synthetic Oligonucleotide
ttttgacttttcaatgggtgtcctagg

SEQ ID NO: 1036 - DNA, 27 bp, Artificial Sequence
  Synthetic Oligonucleotide
tttgacttttcaatgggtgtcctagga

SEQ ID NO: 1037 - DNA, 27 bp, Artificial Sequence
  Synthetic Oligonucleotide
ttgacttttcaatgggtgtcctaggaa

SEQ ID NO: 1038 - DNA, 27 bp, Artificial Sequence
  Synthetic Oligonucleotide
tgacttttcaatgggtgtcctaggaac

SEQ ID NO: 1039 - DNA, 27 bp, Artificial Sequence
  Synthetic Oligonucleotide
gacttttcaatgggtgtcctaggaacc

SEQ ID NO: 1040 - DNA, 27 bp, Artificial Sequence
  Synthetic Oligonucleotide
acttttcaatgggtgtcctaggaacct

SEQ ID NO: 1041 - DNA, 27 bp, Artificial Sequence
  Synthetic Oligonucleotide
cttttcaatgggtgtcctaggaacctt

SEQ ID NO: 1042 - DNA, 27 bp, Artificial Sequence
  Synthetic Oligonucleotide
ttttcaatgggtgtcctaggaaccttt

SEQ ID NO: 1043 - DNA, 27 bp, Artificial Sequence
  Synthetic Oligonucleotide
tttcaatgggtgtcctaggaacctttt

SEQ ID NO: 1044 - DNA, 27 bp, Artificial Sequence
  Synthetic Oligonucleotide
ttcaatgggtgtcctaggaacctttta

SEQ ID NO: 1045 - DNA, 27 bp, Artificial Sequence
  Synthetic Oligonucleotide
tcaatgggtgtcctaggaaccttttag

SEQ ID NO: 1046 - DNA, 27 bp, Artificial Sequence
  Synthetic Oligonucleotide
caatgggtgtcctaggaaccttttaga

SEQ ID NO: 1047 - DNA, 27 bp, Artificial Sequence
  Synthetic Oligonucleotide
aatgggtgtcctaggaaccttttagaa

SEQ ID NO: 1048 - DNA, 27 bp, Artificial Sequence
  Synthetic Oligonucleotide
agaaatggactttcatcctggaaatat

SEQ ID NO: 1049 - DNA, 27 bp, Artificial Sequence
  Synthetic Oligonucleotide
gaaatggactttcatcctggaaatata

SEQ ID NO: 1050 - DNA, 27 bp, Artificial Sequence
  Synthetic Oligonucleotide
aaatggactttcatcctggaaatatat

SEQ ID NO: 1051 - DNA, 27 bp, Artificial Sequence
  Synthetic Oligonucleotide
aatggactttcatcctggaaatatatt

SEQ ID NO: 1052 - DNA, 27 bp, Artificial Sequence
  Synthetic Oligonucleotide
atggactttcatcctggaaatatatta

SEQ ID NO: 1053 - DNA, 27 bp, Artificial Sequence
  Synthetic Oligonucleotide
tggactttcatcctggaaatatattaa

SEQ ID NO: 1054 - DNA, 27 bp, Artificial Sequence
  Synthetic Oligonucleotide
ggactttcatcctggaaatatattaac

SEQ ID NO: 1055 - DNA, 27 bp, Artificial Sequence
  Synthetic Oligonucleotide
gactttcatcctggaaatatattaact

SEQ ID NO: 1056 - DNA, 27 bp, Artificial Sequence
  Synthetic Oligonucleotide
actttcatcctggaaatatattaactg

SEQ ID NO: 1057 - DNA, 27 bp, Artificial Sequence
  Synthetic Oligonucleotide
ctttcatcctggaaatatattaactgt

SEQ ID NO: 1058 - DNA, 27 bp, Artificial Sequence
  Synthetic Oligonucleotide
tttcatcctggaaatatattaactgtt

SEQ ID NO: 1059 - DNA, 27 bp, Artificial Sequence
  Synthetic Oligonucleotide
ttcatcctggaaatatattaactgtta

SEQ ID NO: 1060 - DNA, 27 bp, Artificial Sequence
  Synthetic Oligonucleotide
tcatcctggaaatatattaactgttaa

SEQ ID NO: 1061 - DNA, 27 bp, Artificial Sequence
  Synthetic Oligonucleotide
catcctggaaatatattaactgttaaa

SEQ ID NO: 1062 - DNA, 27 bp, Artificial Sequence
  Synthetic Oligonucleotide
atcctggaaatatattaactgttaaaa

SEQ ID NO: 1063 - DNA, 27 bp, Artificial Sequence
  Synthetic Oligonucleotide
tcctggaaatatattaactgttaaaaa

SEQ ID NO: 1064 - DNA, 27 bp, Artificial Sequence
  Synthetic Oligonucleotide
cctggaaatatattaactgttaaaaag

SEQ ID NO: 1065 - DNA, 27 bp, Artificial Sequence
  Synthetic Oligonucleotide
ctggaaatatattaactgttaaaaaga

SEQ ID NO: 1066 - DNA, 27 bp, Artificial Sequence
  Synthetic Oligonucleotide
tggaaatatattaactgttaaaaagaa

SEQ ID NO: 1067 - DNA, 27 bp, Artificial Sequence
  Synthetic Oligonucleotide
ggaaatatattaactgttaaaaagaaa

SEQ ID NO: 1068 - DNA, 27 bp, Artificial Sequence
  Synthetic Oligonucleotide
gaaatatattaactgttaaaaagaaaa

SEQ ID NO: 1069 - DNA, 27 bp, Artificial Sequence
  Synthetic Oligonucleotide
aaatatattaactgttaaaaagaaaac

SEQ ID NO: 1070 - DNA, 27 bp, Artificial Sequence
  Synthetic Oligonucleotide
aatatattaactgttaaaaagaaaaca

SEQ ID NO: 1071 - DNA, 27 bp, Artificial Sequence
  Synthetic Oligonucleotide
atatattaactgttaaaaagaaaacat

SEQ ID NO: 1072 - DNA, 27 bp, Artificial Sequence
  Synthetic Oligonucleotide
tatattaactgttaaaaagaaaacatt

SEQ ID NO: 1073 - DNA, 27 bp, Artificial Sequence
  Synthetic Oligonucleotide
atattaactgttaaaaagaaaacattg

SEQ ID NO: 1074 - DNA, 27 bp, Artificial Sequence
  Synthetic Oligonucleotide
tattaactgttaaaaagaaaacattga

SEQ ID NO: 1075 - DNA, 27 bp, Artificial Sequence
  Synthetic Oligonucleotide
attaactgttaaaaagaaaacattgaa

SEQ ID NO: 1076 - DNA, 27 bp, Artificial Sequence
  Synthetic Oligonucleotide
ttaactgttaaaaagaaaacattgaaa

SEQ ID NO: 1077 - DNA, 27 bp, Artificial Sequence
  Synthetic Oligonucleotide
taactgttaaaaagaaaacattgaaaa

SEQ ID NO: 1078 - DNA, 27 bp, Artificial Sequence
  Synthetic Oligonucleotide
aactgttaaaaagaaaacattgaaaat

SEQ ID NO: 1079 - DNA, 27 bp, Artificial Sequence
  Synthetic Oligonucleotide
actgttaaaaagaaaacattgaaaatg

SEQ ID NO: 1080 - DNA, 27 bp, Artificial Sequence
  Synthetic Oligonucleotide
ctgttaaaaagaaaacattgaaaatgt

SEQ ID NO: 1081 - DNA, 27 bp, Artificial Sequence
  Synthetic Oligonucleotide
tgttaaaaagaaaacattgaaaatgtg

SEQ ID NO: 1082 - DNA, 27 bp, Artificial Sequence
  Synthetic Oligonucleotide
gacaacgtcatcccctggcaggctaaa

SEQ ID NO: 1083 - DNA, 27 bp, Artificial Sequence
  Synthetic Oligonucleotide
acaacgtcatcccctggcaggctaaag

SEQ ID NO: 1084 - DNA, 27 bp, Artificial Sequence
  Synthetic Oligonucleotide
caacgtcatcccctggcaggctaaagt

SEQ ID NO: 1085 - DNA, 27 bp, Artificial Sequence
  Synthetic Oligonucleotide
aacgtcatcccctggcaggctaaagtg

SEQ ID NO: 1086 - DNA, 27 bp, Artificial Sequence
  Synthetic Oligonucleotide
acgtcatcccctggcaggctaaagtgc

SEQ ID NO: 1087 - DNA, 27 bp, Artificial Sequence
  Synthetic Oligonucleotide
cgtcatcccctggcaggctaaagtgct

SEQ ID NO: 1088 - DNA, 27 bp, Artificial Sequence
  Synthetic Oligonucleotide
gtcatcccctggcaggctaaagtgctg

SEQ ID NO: 1089 - DNA, 27 bp, Artificial Sequence
  Synthetic Oligonucleotide
tcatcccctggcaggctaaagtgctgt

SEQ ID NO: 1090 - DNA, 27 bp, Artificial Sequence
  Synthetic Oligonucleotide
catcccctggcaggctaaagtgctgta

SEQ ID NO: 1091 - DNA, 27 bp, Artificial Sequence
  Synthetic Oligonucleotide
atcccctggcaggctaaagtgctgtat

SEQ ID NO: 1092 - DNA, 27 bp, Artificial Sequence
  Synthetic Oligonucleotide
tcccctggcaggctaaagtgctgtatc

SEQ ID NO: 1093 - DNA, 27 bp, Artificial Sequence
  Synthetic Oligonucleotide
cccctggcaggctaaagtgctgtatcc

SEQ ID NO: 1094 - DNA, 27 bp, Artificial Sequence
  Synthetic Oligonucleotide
ccctggcaggctaaagtgctgtatcct

SEQ ID NO: 1095 - DNA, 27 bp, Artificial Sequence
  Synthetic Oligonucleotide
aggtagcaaacactaaggtgaaaagat

SEQ ID NO: 1096 - DNA, 27 bp, Artificial Sequence
  Synthetic Oligonucleotide
ggtagcaaacactaaggtgaaaagata

SEQ ID NO: 1097 - DNA, 27 bp, Artificial Sequence
  Synthetic Oligonucleotide
gtagcaaacactaaggtgaaaagataa

SEQ ID NO: 1098 - DNA, 27 bp, Artificial Sequence
  Synthetic Oligonucleotide
tagcaaacactaaggtgaaaagataat

SEQ ID NO: 1099 - DNA, 27 bp, Artificial Sequence
  Synthetic Oligonucleotide
gcaaacactaaggtgaaaagataatga

SEQ ID NO: 1100 - DNA, 27 bp, Artificial Sequence
  Synthetic Oligonucleotide
caaacactaaggtgaaaagataatgat

SEQ ID NO: 1101 - DNA, 27 bp, Artificial Sequence
  Synthetic Oligonucleotide
cactaaggtgaaaagataatgatctca

SEQ ID NO: 1102 - DNA, 27 bp, Artificial Sequence
  Synthetic Oligonucleotide
actaaggtgaaaagataatgatctcat

SEQ ID NO: 1103 - DNA, 27 bp, Artificial Sequence
  Synthetic Oligonucleotide
ctaaggtgaaaagataatgatctcatt

SEQ ID NO: 1104 - DNA, 27 bp, Artificial Sequence
  Synthetic Oligonucleotide
taaggtgaaaagataatgatctcattg

SEQ ID NO: 1105 - DNA, 27 bp, Artificial Sequence
  Synthetic Oligonucleotide
aaggtgaaaagataatgatctcattgt

SEQ ID NO: 1106 - DNA, 27 bp, Artificial Sequence
  Synthetic Oligonucleotide
aggtgaaaagataatgatctcattgtt

SEQ ID NO: 1107 - DNA, 27 bp, Artificial Sequence
  Synthetic Oligonucleotide
ggtgaaaagataatgatctcattgttt

SEQ ID NO: 1108 - DNA, 27 bp, Artificial Sequence
  Synthetic Oligonucleotide
gtgaaaagataatgatctcattgttta

SEQ ID NO: 1109 - DNA, 27 bp, Artificial Sequence
  Synthetic Oligonucleotide
tgaaaagataatgatctcattgtttat

SEQ ID NO: 1110 - DNA, 27 bp, Artificial Sequence
  Synthetic Oligonucleotide
gaaaagataatgatctcattgtttatt

SEQ ID NO: 1111 - DNA, 27 bp, Artificial Sequence
  Synthetic Oligonucleotide
aaaagataatgatctcattgtttatta

SEQ ID NO: 1112 - DNA, 27 bp, Artificial Sequence
  Synthetic Oligonucleotide
aaagataatgatctcattgtttattaa

SEQ ID NO: 1113 - DNA, 27 bp, Artificial Sequence
  Synthetic Oligonucleotide
aagataatgatctcattgtttattaac

SEQ ID NO: 1114 - DNA, 27 bp, Artificial Sequence
  Synthetic Oligonucleotide
agataatgatctcattgtttattaacc

SEQ ID NO: 1115 - DNA, 27 bp, Artificial Sequence
  Synthetic Oligonucleotide
gataatgatctcattgtttattaacct

SEQ ID NO: 1116 - DNA, 27 bp, Artificial Sequence
  Synthetic Oligonucleotide
ataatgatctcattgtttattaacctg

SEQ ID NO: 1117 - DNA, 27 bp, Artificial Sequence
  Synthetic Oligonucleotide
taatgatctcattgtttattaacctgt

SEQ ID NO: 1118 - DNA, 27 bp, Artificial Sequence
  Synthetic Oligonucleotide
aatgatctcattgtttattaacctgta

SEQ ID NO: 1119 - DNA, 27 bp, Artificial Sequence
  Synthetic Oligonucleotide
atgatctcattgtttattaacctgtat

SEQ ID NO: 1120 - DNA, 27 bp, Artificial Sequence
  Synthetic Oligonucleotide
tgatctcattgtttattaacctgtatt

SEQ ID NO: 1121 - DNA, 27 bp, Artificial Sequence
  Synthetic Oligonucleotide
gatctcattgtttattaacctgtattc

SEQ ID NO: 1122 - DNA, 27 bp, Artificial Sequence
  Synthetic Oligonucleotide
atctcattgtttattaacctgtattct

SEQ ID NO: 1123 - DNA, 27 bp, Artificial Sequence
  Synthetic Oligonucleotide
tctcattgtttattaacctgtattctg

SEQ ID NO: 1124 - DNA, 27 bp, Artificial Sequence
  Synthetic Oligonucleotide
ctcattgtttattaacctgtattctgt

SEQ ID NO: 1125 - DNA, 27 bp, Artificial Sequence
  Synthetic Oligonucleotide
tcattgtttattaacctgtattctgtt

SEQ ID NO: 1126 - DNA, 27 bp, Artificial Sequence
  Synthetic Oligonucleotide
ttgtttattaacctgtattctgtttac

SEQ ID NO: 1127 - DNA, 27 bp, Artificial Sequence
  Synthetic Oligonucleotide
tgtttattaacctgtattctgtttaca

SEQ ID NO: 1128 - DNA, 27 bp, Artificial Sequence
  Synthetic Oligonucleotide
ttattaacctgtattctgtttacatgt

SEQ ID NO: 1129 - DNA, 27 bp, Artificial Sequence
  Synthetic Oligonucleotide
tattaacctgtattctgtttacatgtc

SEQ ID NO: 1130 - DNA, 27 bp, Artificial Sequence
  Synthetic Oligonucleotide
ctttaaaacagtggttcttaaattgta

SEQ ID NO: 1131 - DNA, 27 bp, Artificial Sequence
  Synthetic Oligonucleotide
tttaaaacagtggttcttaaattgtaa

SEQ ID NO: 1132 - DNA, 27 bp, Artificial Sequence
  Synthetic Oligonucleotide
ttaaaacagtggttcttaaattgtaag

SEQ ID NO: 1133 - DNA, 27 bp, Artificial Sequence
  Synthetic Oligonucleotide
taaaacagtggttcttaaattgtaagc

SEQ ID NO: 1134 - DNA, 27 bp, Artificial Sequence
  Synthetic Oligonucleotide
aaaacagtggttcttaaattgtaagct

SEQ ID NO: 1135 - DNA, 27 bp, Artificial Sequence
  Synthetic Oligonucleotide
aaacagtggttcttaaattgtaagctc

SEQ ID NO: 1136 - DNA, 27 bp, Artificial Sequence
  Synthetic Oligonucleotide
aacagtggttcttaaattgtaagctca

SEQ ID NO: 1137 - DNA, 27 bp, Artificial Sequence
  Synthetic Oligonucleotide
tggttcttaaattgtaagctcaggttc

SEQ ID NO: 1138 - DNA, 27 bp, Artificial Sequence
  Synthetic Oligonucleotide
ttcttaaattgtaagctcaggttcaaa

SEQ ID NO: 1139 - DNA, 27 bp, Artificial Sequence
  Synthetic Oligonucleotide
tcttaaattgtaagctcaggttcaaag

SEQ ID NO: 1140 - DNA, 27 bp, Artificial Sequence
  Synthetic Oligonucleotide
ttaaattgtaagctcaggttcaaagtg

SEQ ID NO: 1141 - DNA, 27 bp, Artificial Sequence
  Synthetic Oligonucleotide
taaattgtaagctcaggttcaaagtgt

SEQ ID NO: 1142 - DNA, 27 bp, Artificial Sequence
  Synthetic Oligonucleotide
aaattgtaagctcaggttcaaagtgtt

SEQ ID NO: 1143 - DNA, 27 bp, Artificial Sequence
  Synthetic Oligonucleotide
ttggtgatacttctttgaatgtagatt

SEQ ID NO: 1144 - DNA, 27 bp, Artificial Sequence
  Synthetic Oligonucleotide
caatcacatctttagtgtctgaatata

SEQ ID NO: 1145 - DNA, 27 bp, Artificial Sequence
  Synthetic Oligonucleotide
tttagtgtctgaatatatccaaatgtt

SEQ ID NO: 1146 - DNA, 27 bp, Artificial Sequence
  Synthetic Oligonucleotide
ttagtgtctgaatatatccaaatgttt

SEQ ID NO: 1147 - DNA, 27 bp, Artificial Sequence
  Synthetic Oligonucleotide
tagtgtctgaatatatccaaatgtttt

SEQ ID NO: 1148 - DNA, 27 bp, Artificial Sequence
  Synthetic Oligonucleotide
gtgtctgaatatatccaaatgttttag

SEQ ID NO: 1149 - DNA, 27 bp, Artificial Sequence
  Synthetic Oligonucleotide
tgtctgaatatatccaaatgttttagg

SEQ ID NO: 1150 - DNA, 27 bp, Artificial Sequence
  Synthetic Oligonucleotide
gtctgaatatatccaaatgttttagga

SEQ ID NO: 1151 - DNA, 27 bp, Artificial Sequence
  Synthetic Oligonucleotide
tctgaatatatccaaatgttttaggat

SEQ ID NO: 1152 - DNA, 27 bp, Artificial Sequence
  Synthetic Oligonucleotide
ctgaatatatccaaatgttttaggatg

SEQ ID NO: 1153 - RNA, 25 nt, Artificial Sequence
  Synthetic Oligonucleotide
ggcuaauuuguaucaaugauuauga

SEQ ID NO: 1154 - RNA, 25 nt, Artificial Sequence
  Synthetic Oligonucleotide
gcuaauuuguaucaaugauuaugaa

SEQ ID NO: 1155 - RNA, 25 nt, Artificial Sequence
  Synthetic Oligonucleotide
cuaauuuguaucaaugauuaugaac

SEQ ID NO: 1156 - RNA, 25 nt, Artificial Sequence
  Synthetic Oligonucleotide
uaauuuguaucaaugauuaugaaca

SEQ ID NO: 1157 - RNA, 25 nt, Artificial Sequence
  Synthetic Oligonucleotide
aauuuguaucaaugauuaugaacaa

SEQ ID NO: 1158 - RNA, 25 nt, Artificial Sequence
  Synthetic Oligonucleotide
auuuguaucaaugauuaugaacaac

SEQ ID NO: 1159 - RNA, 25 nt, Artificial Sequence
  Synthetic Oligonucleotide
uuuguaucaaugauuaugaacaaca

SEQ ID NO: 1160 - RNA, 25 nt, Artificial Sequence
  Synthetic Oligonucleotide
uuguaucaaugauuaugaacaacau

SEQ ID NO: 1161 - RNA, 25 nt, Artificial Sequence
  Synthetic Oligonucleotide
uguaucaaugauuaugaacaacaug

SEQ ID NO: 1162 - RNA, 25 nt, Artificial Sequence
  Synthetic Oligonucleotide
guaucaaugauuaugaacaacaugc

SEQ ID NO: 1163 - RNA, 25 nt, Artificial Sequence
  Synthetic Oligonucleotide
aucaaugauuaugaacaacaugcua

SEQ ID NO: 1164 - RNA, 25 nt, Artificial Sequence
  Synthetic Oligonucleotide
ucaaugauuaugaacaacaugcuaa

SEQ ID NO: 1165 - RNA, 25 nt, Artificial Sequence
  Synthetic Oligonucleotide
caaugauuaugaacaacaugcuaaa

SEQ ID NO: 1166 - RNA, 25 nt, Artificial Sequence
  Synthetic Oligonucleotide
aaugauuaugaacaacaugcuaaau

SEQ ID NO: 1167 - RNA, 25 nt, Artificial Sequence
  Synthetic Oligonucleotide
augauuaugaacaacaugcuaaauc

SEQ ID NO: 1168 - RNA, 25 nt, Artificial Sequence
  Synthetic Oligonucleotide
ugauuaugaacaacaugcuaaauca

SEQ ID NO: 1169 - RNA, 25 nt, Artificial Sequence
  Synthetic Oligonucleotide
gauuaugaacaacaugcuaaaucag

SEQ ID NO: 1170 - RNA, 25 nt, Artificial Sequence
  Synthetic Oligonucleotide
auuaugaacaacaugcuaaaucagu

SEQ ID NO: 1171 - RNA, 25 nt, Artificial Sequence
  Synthetic Oligonucleotide
augaacaacaugcuaaaucaguacu

SEQ ID NO: 1172 - RNA, 25 nt, Artificial Sequence
  Synthetic Oligonucleotide
gaacaacaugcuaaaucaguacuuc

SEQ ID NO: 1173 - RNA, 25 nt, Artificial Sequence
  Synthetic Oligonucleotide
aacaacaugcuaaaucaguacuucc

SEQ ID NO: 1174 - RNA, 25 nt, Artificial Sequence
  Synthetic Oligonucleotide
aacaugcuaaaucaguacuuccaaa

SEQ ID NO: 1175 - RNA, 25 nt, Artificial Sequence
  Synthetic Oligonucleotide
aaucaguacuuccaaagucuauaua

SEQ ID NO: 1176 - RNA, 25 nt, Artificial Sequence
  Synthetic Oligonucleotide
aucaguacuuccaaagucuauauau

SEQ ID NO: 1177 - RNA, 25 nt, Artificial Sequence
  Synthetic Oligonucleotide
caguacuuccaaagucuauauauga

SEQ ID NO: 1178 - RNA, 25 nt, Artificial Sequence
  Synthetic Oligonucleotide
aguacuuccaaagucuauauaugac

SEQ ID NO: 1179 - RNA, 25 nt, Artificial Sequence
  Synthetic Oligonucleotide
guacuuccaaagucuauauaugacu

SEQ ID NO: 1180 - RNA, 25 nt, Artificial Sequence
  Synthetic Oligonucleotide
cuuccaaagucuauauaugacuauu

SEQ ID NO: 1181 - RNA, 25 nt, Artificial Sequence
  Synthetic Oligonucleotide
ccaaagucuauauaugacuauuaca

SEQ ID NO: 1182 - RNA, 25 nt, Artificial Sequence
  Synthetic Oligonucleotide
caaagucuauauaugacuauuacag

SEQ ID NO: 1183 - RNA, 25 nt, Artificial Sequence
  Synthetic Oligonucleotide
aagucuauauaugacuauuacaggu

SEQ ID NO: 1184 - RNA, 25 nt, Artificial Sequence
  Synthetic Oligonucleotide
uaugacuauuacaggucuggggcaa

SEQ ID NO: 1185 - RNA, 25 nt, Artificial Sequence
  Synthetic Oligonucleotide
augacuauuacaggucuggggcaaa

SEQ ID NO: 1186 - RNA, 25 nt, Artificial Sequence
  Synthetic Oligonucleotide
ugacuauuacaggucuggggcaaau

SEQ ID NO: 1187 - RNA, 25 nt, Artificial Sequence
  Synthetic Oligonucleotide
gacuauuacaggucuggggcaaaug

SEQ ID NO: 1188 - RNA, 25 nt, Artificial Sequence
  Synthetic Oligonucleotide
acuauuacaggucuggggcaaauga

SEQ ID NO: 1189 - RNA, 25 nt, Artificial Sequence
  Synthetic Oligonucleotide
cuauuacaggucuggggcaaaugau

SEQ ID NO: 1190 - RNA, 25 nt, Artificial Sequence
  Synthetic Oligonucleotide
uauuacaggucuggggcaaaugaug

SEQ ID NO: 1191 - RNA, 25 nt, Artificial Sequence
  Synthetic Oligonucleotide
auuacaggucuggggcaaaugauga

SEQ ID NO: 1192 - RNA, 25 nt, Artificial Sequence
  Synthetic Oligonucleotide
uuacaggucuggggcaaaugaugaa

SEQ ID NO: 1193 - RNA, 25 nt, Artificial Sequence
  Synthetic Oligonucleotide
uacaggucuggggcaaaugaugaag

SEQ ID NO: 1194 - RNA, 25 nt, Artificial Sequence
  Synthetic Oligonucleotide
acaggucuggggcaaaugaugaaga

SEQ ID NO: 1195 - RNA, 25 nt, Artificial Sequence
  Synthetic Oligonucleotide
caggucuggggcaaaugaugaagaa

SEQ ID NO: 1196 - RNA, 25 nt, Artificial Sequence
  Synthetic Oligonucleotide
ggaauguugcugaaacagaucuguc

SEQ ID NO: 1197 - RNA, 25 nt, Artificial Sequence
  Synthetic Oligonucleotide
acuucuguuuuaggacagaggguca

SEQ ID NO: 1198 - RNA, 25 nt, Artificial Sequence
  Synthetic Oligonucleotide
cuucuguuuuaggacagagggucag

SEQ ID NO: 1199 - RNA, 25 nt, Artificial Sequence
  Synthetic Oligonucleotide
uacaaggccauauuugugacagugg

SEQ ID NO: 1200 - RNA, 25 nt, Artificial Sequence
  Synthetic Oligonucleotide
acaaggccauauuugugacagugga

SEQ ID NO: 1201 - RNA, 25 nt, Artificial Sequence
  Synthetic Oligonucleotide
ccacaacucaggaugaaaaauuuug

SEQ ID NO: 1202 - RNA, 25 nt, Artificial Sequence
  Synthetic Oligonucleotide
cacaacucaggaugaaaaauuuuga

SEQ ID NO: 1203 - RNA, 25 nt, Artificial Sequence
  Synthetic Oligonucleotide
acaacucaggaugaaaaauuuugaa

SEQ ID NO: 1204 - RNA, 25 nt, Artificial Sequence
  Synthetic Oligonucleotide
caacucaggaugaaaaauuuugaaa

SEQ ID NO: 1205 - RNA, 25 nt, Artificial Sequence
  Synthetic Oligonucleotide
aacucaggaugaaaaauuuugaaac

SEQ ID NO: 1206 - RNA, 25 nt, Artificial Sequence
  Synthetic Oligonucleotide
cucaggaugaaaaauuuugaaacca

SEQ ID NO: 1207 - RNA, 25 nt, Artificial Sequence
  Synthetic Oligonucleotide
ucaggaugaaaaauuuugaaaccag

SEQ ID NO: 1208 - RNA, 25 nt, Artificial Sequence
  Synthetic Oligonucleotide
caggaugaaaaauuuugaaaccagu

SEQ ID NO: 1209 - RNA, 25 nt, Artificial Sequence
  Synthetic Oligonucleotide
aggaugaaaaauuuugaaaccagua

SEQ ID NO: 1210 - RNA, 25 nt, Artificial Sequence
  Synthetic Oligonucleotide
gaugaaaaauuuugaaaccaguacu

SEQ ID NO: 1211 - RNA, 25 nt, Artificial Sequence
  Synthetic Oligonucleotide
augaaaaauuuugaaaccaguacuu

SEQ ID NO: 1212 - RNA, 25 nt, Artificial Sequence
  Synthetic Oligonucleotide
ugaaaaauuuugaaaccaguacuuu

SEQ ID NO: 1213 - RNA, 25 nt, Artificial Sequence
  Synthetic Oligonucleotide
gaaaaauuuugaaaccaguacuuua

SEQ ID NO: 1214 - RNA, 25 nt, Artificial Sequence
  Synthetic Oligonucleotide
aaaaauuuugaaaccaguacuuuau

SEQ ID NO: 1215 - RNA, 25 nt, Artificial Sequence
  Synthetic Oligonucleotide
aaaauuuugaaaccaguacuuuauc

SEQ ID NO: 1216 - RNA, 25 nt, Artificial Sequence
  Synthetic Oligonucleotide
aaauuuugaaaccaguacuuuauca

SEQ ID NO: 1217 - RNA, 25 nt, Artificial Sequence
  Synthetic Oligonucleotide
aauuuugaaaccaguacuuuaucau

SEQ ID NO: 1218 - RNA, 25 nt, Artificial Sequence
  Synthetic Oligonucleotide
auuuugaaaccaguacuuuaucauu

SEQ ID NO: 1219 - RNA, 25 nt, Artificial Sequence
  Synthetic Oligonucleotide
uuuugaaaccaguacuuuaucauuu

SEQ ID NO: 1220 - RNA, 25 nt, Artificial Sequence
  Synthetic Oligonucleotide
uuugaaaccaguacuuuaucauuuu

SEQ ID NO: 1221 - RNA, 25 nt, Artificial Sequence
  Synthetic Oligonucleotide
uugaaaccaguacuuuaucauuuuc

SEQ ID NO: 1222 - RNA, 25 nt, Artificial Sequence
  Synthetic Oligonucleotide
ugaaaccaguacuuuaucauuuucu

SEQ ID NO: 1223 - RNA, 25 nt, Artificial Sequence
  Synthetic Oligonucleotide
gaaaccaguacuuuaucauuuucuc

SEQ ID NO: 1224 - RNA, 25 nt, Artificial Sequence
  Synthetic Oligonucleotide
aaaccaguacuuuaucauuuucucc

SEQ ID NO: 1225 - RNA, 25 nt, Artificial Sequence
  Synthetic Oligonucleotide
aaccaguacuuuaucauuuucuccu

SEQ ID NO: 1226 - RNA, 25 nt, Artificial Sequence
  Synthetic Oligonucleotide
ccaguacuuuaucauuuucuccuga

SEQ ID NO: 1227 - RNA, 25 nt, Artificial Sequence
  Synthetic Oligonucleotide
caguacuuuaucauuuucuccugag

SEQ ID NO: 1228 - RNA, 25 nt, Artificial Sequence
  Synthetic Oligonucleotide
aucauuuucuccugaggaaaauuuu

SEQ ID NO: 1229 - RNA, 25 nt, Artificial Sequence
  Synthetic Oligonucleotide
aauggcugagaagacugacaucauu

SEQ ID NO: 1230 - RNA, 25 nt, Artificial Sequence
  Synthetic Oligonucleotide
aaagggcauuuugagaggugaugau

SEQ ID NO: 1231 - RNA, 25 nt, Artificial Sequence
  Synthetic Oligonucleotide
aagggcauuuugagaggugaugaug

SEQ ID NO: 1232 - RNA, 25 nt, Artificial Sequence
  Synthetic Oligonucleotide
agggcauuuugagaggugaugaugc

SEQ ID NO: 1233 - RNA, 25 nt, Artificial Sequence
  Synthetic Oligonucleotide
gggcauuuugagaggugaugaugcc

SEQ ID NO: 1234 - RNA, 25 nt, Artificial Sequence
  Synthetic Oligonucleotide
ggcauuuugagaggugaugaugcca

SEQ ID NO: 1235 - RNA, 25 nt, Artificial Sequence
  Synthetic Oligonucleotide
gcauuuugagaggugaugaugccag

SEQ ID NO: 1236 - RNA, 25 nt, Artificial Sequence
  Synthetic Oligonucleotide
cauuuugagaggugaugaugccagg

SEQ ID NO: 1237 - RNA, 25 nt, Artificial Sequence
  Synthetic Oligonucleotide
auuuugagaggugaugaugccaggg

SEQ ID NO: 1238 - RNA, 25 nt, Artificial Sequence
  Synthetic Oligonucleotide
uuuugagaggugaugaugccaggga

SEQ ID NO: 1239 - RNA, 25 nt, Artificial Sequence
  Synthetic Oligonucleotide
uuugagaggugaugaugccagggag

SEQ ID NO: 1240 - RNA, 25 nt, Artificial Sequence
  Synthetic Oligonucleotide
uugagaggugaugaugccagggagg

SEQ ID NO: 1241 - RNA, 25 nt, Artificial Sequence
  Synthetic Oligonucleotide
augggaucuuggugucgaaucaugg

SEQ ID NO: 1242 - RNA, 25 nt, Artificial Sequence
  Synthetic Oligonucleotide
ugggaucuuggugucgaaucauggg

SEQ ID NO: 1243 - RNA, 25 nt, Artificial Sequence
  Synthetic Oligonucleotide
gggaucuuggugucgaaucaugggg

SEQ ID NO: 1244 - RNA, 25 nt, Artificial Sequence
  Synthetic Oligonucleotide
ggaucuuggugucgaaucauggggc

SEQ ID NO: 1245 - RNA, 25 nt, Artificial Sequence
  Synthetic Oligonucleotide
gaucuuggugucgaaucauggggcu

SEQ ID NO: 1246 - RNA, 25 nt, Artificial Sequence
  Synthetic Oligonucleotide
aucuuggugucgaaucauggggcuc

SEQ ID NO: 1247 - RNA, 25 nt, Artificial Sequence
  Synthetic Oligonucleotide
ucuuggugucgaaucauggggcucg

SEQ ID NO: 1248 - RNA, 25 nt, Artificial Sequence
  Synthetic Oligonucleotide
cuuggugucgaaucauggggcucga

SEQ ID NO: 1249 - RNA, 25 nt, Artificial Sequence
  Synthetic Oligonucleotide
uuggugucgaaucauggggcucgac

SEQ ID NO: 1250 - RNA, 25 nt, Artificial Sequence
  Synthetic Oligonucleotide
uggugucgaaucauggggcucgaca

SEQ ID NO: 1251 - RNA, 25 nt, Artificial Sequence
  Synthetic Oligonucleotide
ccacuauugauguucugccagaaau

SEQ ID NO: 1252 - RNA, 25 nt, Artificial Sequence
  Synthetic Oligonucleotide
cuauugauguucugccagaaauugu

SEQ ID NO: 1253 - RNA, 25 nt, Artificial Sequence
  Synthetic Oligonucleotide
uauugauguucugccagaaauugug

SEQ ID NO: 1254 - RNA, 25 nt, Artificial Sequence
  Synthetic Oligonucleotide
gaggcuguggaagggaagguggaag

SEQ ID NO: 1255 - RNA, 25 nt, Artificial Sequence
  Synthetic Oligonucleotide
aggcuguggaagggaagguggaagu

SEQ ID NO: 1256 - RNA, 25 nt, Artificial Sequence
  Synthetic Oligonucleotide
ggagaaagguguucaagauguccuc

SEQ ID NO: 1257 - RNA, 25 nt, Artificial Sequence
  Synthetic Oligonucleotide
gagaaagguguucaagauguccucg

SEQ ID NO: 1258 - RNA, 25 nt, Artificial Sequence
  Synthetic Oligonucleotide
agaaagguguucaagauguccucga

SEQ ID NO: 1259 - RNA, 25 nt, Artificial Sequence
  Synthetic Oligonucleotide
gaaagguguucaagauguccucgag

SEQ ID NO: 1260 - RNA, 25 nt, Artificial Sequence
  Synthetic Oligonucleotide
aaagguguucaagauguccucgaga

SEQ ID NO: 1261 - RNA, 25 nt, Artificial Sequence
  Synthetic Oligonucleotide
aagguguucaagauguccucgagau

SEQ ID NO: 1262 - RNA, 25 nt, Artificial Sequence
  Synthetic Oligonucleotide
agguguucaagauguccucgagaua

SEQ ID NO: 1263 - RNA, 25 nt, Artificial Sequence
  Synthetic Oligonucleotide
gguguucaagauguccucgagauac

SEQ ID NO: 1264 - RNA, 25 nt, Artificial Sequence
  Synthetic Oligonucleotide
guguucaagauguccucgagauacu

SEQ ID NO: 1265 - RNA, 25 nt, Artificial Sequence
  Synthetic Oligonucleotide
uguucaagauguccucgagauacua

SEQ ID NO: 1266 - RNA, 25 nt, Artificial Sequence
  Synthetic Oligonucleotide
guucaagauguccucgagauacuaa

SEQ ID NO: 1267 - RNA, 25 nt, Artificial Sequence
  Synthetic Oligonucleotide
uucaagauguccucgagauacuaaa

SEQ ID NO: 1268 - RNA, 25 nt, Artificial Sequence
  Synthetic Oligonucleotide
ucaagauguccucgagauacuaaag

SEQ ID NO: 1269 - RNA, 25 nt, Artificial Sequence
  Synthetic Oligonucleotide
uggccauggcucugagugggugcca

SEQ ID NO: 1270 - RNA, 25 nt, Artificial Sequence
  Synthetic Oligonucleotide
ggccauggcucugagugggugccag

SEQ ID NO: 1271 - RNA, 25 nt, Artificial Sequence
  Synthetic Oligonucleotide
gccauggcucugagugggugccaga

SEQ ID NO: 1272 - RNA, 25 nt, Artificial Sequence
  Synthetic Oligonucleotide
ccauggcucugagugggugccagaa

SEQ ID NO: 1273 - RNA, 25 nt, Artificial Sequence
  Synthetic Oligonucleotide
cauggcucugagugggugccagaau

SEQ ID NO: 1274 - RNA, 25 nt, Artificial Sequence
  Synthetic Oligonucleotide
auggcucugagugggugccagaaug

SEQ ID NO: 1275 - RNA, 25 nt, Artificial Sequence
  Synthetic Oligonucleotide
uggcucugagugggugccagaaugu

SEQ ID NO: 1276 - RNA, 25 nt, Artificial Sequence
  Synthetic Oligonucleotide
ggcucugagugggugccagaaugug

SEQ ID NO: 1277 - RNA, 25 nt, Artificial Sequence
  Synthetic Oligonucleotide
gcucugagugggugccagaauguga

SEQ ID NO: 1278 - RNA, 25 nt, Artificial Sequence
  Synthetic Oligonucleotide
cucugagugggugccagaaugugaa

SEQ ID NO: 1279 - RNA, 25 nt, Artificial Sequence
  Synthetic Oligonucleotide
ucugagugggugccagaaugugaaa

SEQ ID NO: 1280 - RNA, 25 nt, Artificial Sequence
  Synthetic Oligonucleotide
cugagugggugccagaaugugaaag

SEQ ID NO: 1281 - RNA, 25 nt, Artificial Sequence
  Synthetic Oligonucleotide
ugagugggugccagaaugugaaagu

SEQ ID NO: 1282 - RNA, 25 nt, Artificial Sequence
  Synthetic Oligonucleotide
gagugggugccagaaugugaaaguc

SEQ ID NO: 1283 - RNA, 25 nt, Artificial Sequence
  Synthetic Oligonucleotide
agugggugccagaaugugaaaguca

SEQ ID NO: 1284 - RNA, 25 nt, Artificial Sequence
  Synthetic Oligonucleotide
gugggugccagaaugugaaagucau

SEQ ID NO: 1285 - RNA, 25 nt, Artificial Sequence
  Synthetic Oligonucleotide
ugggugccagaaugugaaagucauc

SEQ ID NO: 1286 - RNA, 25 nt, Artificial Sequence
  Synthetic Oligonucleotide
gggugccagaaugugaaagucaucg

SEQ ID NO: 1287 - RNA, 25 nt, Artificial Sequence
  Synthetic Oligonucleotide
ggugccagaaugugaaagucaucga

SEQ ID NO: 1288 - RNA, 25 nt, Artificial Sequence
  Synthetic Oligonucleotide
gugccagaaugugaaagucaucgac

SEQ ID NO: 1289 - RNA, 25 nt, Artificial Sequence
  Synthetic Oligonucleotide
ugccagaaugugaaagucaucgaca

SEQ ID NO: 1290 - RNA, 25 nt, Artificial Sequence
  Synthetic Oligonucleotide
gccagaaugugaaagucaucgacaa

SEQ ID NO: 1291 - RNA, 25 nt, Artificial Sequence
  Synthetic Oligonucleotide
ccagaaugugaaagucaucgacaag

SEQ ID NO: 1292 - RNA, 25 nt, Artificial Sequence
  Synthetic Oligonucleotide
cagaaugugaaagucaucgacaaga

SEQ ID NO: 1293 - RNA, 25 nt, Artificial Sequence
  Synthetic Oligonucleotide
agaaugugaaagucaucgacaagac

SEQ ID NO: 1294 - RNA, 25 nt, Artificial Sequence
  Synthetic Oligonucleotide
gaaugugaaagucaucgacaagaca

SEQ ID NO: 1295 - RNA, 25 nt, Artificial Sequence
  Synthetic Oligonucleotide
aaugugaaagucaucgacaagacau

SEQ ID NO: 1296 - RNA, 25 nt, Artificial Sequence
  Synthetic Oligonucleotide
augugaaagucaucgacaagacauu

SEQ ID NO: 1297 - RNA, 25 nt, Artificial Sequence
  Synthetic Oligonucleotide
ugugaaagucaucgacaagacauug

SEQ ID NO: 1298 - RNA, 25 nt, Artificial Sequence
  Synthetic Oligonucleotide
gugaaagucaucgacaagacauugg

SEQ ID NO: 1299 - RNA, 25 nt, Artificial Sequence
  Synthetic Oligonucleotide
ugaaagucaucgacaagacauuggu

SEQ ID NO: 1300 - RNA, 25 nt, Artificial Sequence
  Synthetic Oligonucleotide
gaaagucaucgacaagacauuggug

SEQ ID NO: 1301 - RNA, 25 nt, Artificial Sequence
  Synthetic Oligonucleotide
aaagucaucgacaagacauugguga

SEQ ID NO: 1302 - RNA, 25 nt, Artificial Sequence
  Synthetic Oligonucleotide
aagucaucgacaagacauuggugag

SEQ ID NO: 1303 - RNA, 25 nt, Artificial Sequence
  Synthetic Oligonucleotide
agucaucgacaagacauuggugagg

SEQ ID NO: 1304 - RNA, 25 nt, Artificial Sequence
  Synthetic Oligonucleotide
gucaucgacaagacauuggugagga

SEQ ID NO: 1305 - RNA, 25 nt, Artificial Sequence
  Synthetic Oligonucleotide
ucaucgacaagacauuggugaggaa

SEQ ID NO: 1306 - RNA, 25 nt, Artificial Sequence
  Synthetic Oligonucleotide
caucgacaagacauuggugaggaaa

SEQ ID NO: 1307 - RNA, 25 nt, Artificial Sequence
  Synthetic Oligonucleotide
aucgacaagacauuggugaggaaaa

SEQ ID NO: 1308 - RNA, 25 nt, Artificial Sequence
  Synthetic Oligonucleotide
ucgacaagacauuggugaggaaaaa

SEQ ID NO: 1309 - RNA, 25 nt, Artificial Sequence
  Synthetic Oligonucleotide
cgacaagacauuggugaggaaaaau

SEQ ID NO: 1310 - RNA, 25 nt, Artificial Sequence
  Synthetic Oligonucleotide
gacaagacauuggugaggaaaaauc

SEQ ID NO: 1311 - RNA, 25 nt, Artificial Sequence
  Synthetic Oligonucleotide
acaagacauuggugaggaaaaaucc

SEQ ID NO: 1312 - RNA, 25 nt, Artificial Sequence
  Synthetic Oligonucleotide
caagacauuggugaggaaaaauccu

SEQ ID NO: 1313 - RNA, 25 nt, Artificial Sequence
  Synthetic Oligonucleotide
aagacauuggugaggaaaaauccuu

SEQ ID NO: 1314 - RNA, 25 nt, Artificial Sequence
  Synthetic Oligonucleotide
agacauuggugaggaaaaauccuuu

SEQ ID NO: 1315 - RNA, 25 nt, Artificial Sequence
  Synthetic Oligonucleotide
gacauuggugaggaaaaauccuuug

SEQ ID NO: 1316 - RNA, 25 nt, Artificial Sequence
  Synthetic Oligonucleotide
acauuggugaggaaaaauccuuugg

SEQ ID NO: 1317 - RNA, 25 nt, Artificial Sequence
  Synthetic Oligonucleotide
cauuggugaggaaaaauccuuuggc

SEQ ID NO: 1318 - RNA, 25 nt, Artificial Sequence
  Synthetic Oligonucleotide
auuggugaggaaaaauccuuuggcc

SEQ ID NO: 1319 - RNA, 25 nt, Artificial Sequence
  Synthetic Oligonucleotide
uuggugaggaaaaauccuuuggccg

SEQ ID NO: 1320 - RNA, 25 nt, Artificial Sequence
  Synthetic Oligonucleotide
uggugaggaaaaauccuuuggccgu

SEQ ID NO: 1321 - RNA, 25 nt, Artificial Sequence
  Synthetic Oligonucleotide
ggugaggaaaaauccuuuggccguu

SEQ ID NO: 1322 - RNA, 25 nt, Artificial Sequence
  Synthetic Oligonucleotide
gugaggaaaaauccuuuggccguuu

SEQ ID NO: 1323 - RNA, 25 nt, Artificial Sequence
  Synthetic Oligonucleotide
ugaggaaaaauccuuuggccguuuc

SEQ ID NO: 1324 - RNA, 25 nt, Artificial Sequence
  Synthetic Oligonucleotide
guuuccaagaucugacagugcacaa

SEQ ID NO: 1325 - RNA, 25 nt, Artificial Sequence
  Synthetic Oligonucleotide
uuuccaagaucugacagugcacaau

SEQ ID NO: 1326 - RNA, 25 nt, Artificial Sequence
  Synthetic Oligonucleotide
uuccaagaucugacagugcacaaua

SEQ ID NO: 1327 - RNA, 25 nt, Artificial Sequence
  Synthetic Oligonucleotide
uccaagaucugacagugcacaauau

SEQ ID NO: 1328 - RNA, 25 nt, Artificial Sequence
  Synthetic Oligonucleotide
ccaagaucugacagugcacaauauu

SEQ ID NO: 1329 - RNA, 25 nt, Artificial Sequence
  Synthetic Oligonucleotide
caagaucugacagugcacaauauuu

SEQ ID NO: 1330 - RNA, 25 nt, Artificial Sequence
  Synthetic Oligonucleotide
aagaucugacagugcacaauauuuu

SEQ ID NO: 1331 - RNA, 25 nt, Artificial Sequence
  Synthetic Oligonucleotide
agaucugacagugcacaauauuuuc

SEQ ID NO: 1332 - RNA, 25 nt, Artificial Sequence
  Synthetic Oligonucleotide
gaucugacagugcacaauauuuucc

SEQ ID NO: 1333 - RNA, 25 nt, Artificial Sequence
  Synthetic Oligonucleotide
aucugacagugcacaauauuuuccc

SEQ ID NO: 1334 - RNA, 25 nt, Artificial Sequence
  Synthetic Oligonucleotide
ucugacagugcacaauauuuuccca

SEQ ID NO: 1335 - RNA, 25 nt, Artificial Sequence
  Synthetic Oligonucleotide
cugacagugcacaauauuuucccau

SEQ ID NO: 1336 - RNA, 25 nt, Artificial Sequence
  Synthetic Oligonucleotide
ugacagugcacaauauuuucccauc

SEQ ID NO: 1337 - RNA, 25 nt, Artificial Sequence
  Synthetic Oligonucleotide
gacagugcacaauauuuucccaucu

SEQ ID NO: 1338 - RNA, 25 nt, Artificial Sequence
  Synthetic Oligonucleotide
acagugcacaauauuuucccaucug

SEQ ID NO: 1339 - RNA, 25 nt, Artificial Sequence
  Synthetic Oligonucleotide
cagugcacaauauuuucccaucugu

SEQ ID NO: 1340 - RNA, 25 nt, Artificial Sequence
  Synthetic Oligonucleotide
agugcacaauauuuucccaucugua

SEQ ID NO: 1341 - RNA, 25 nt, Artificial Sequence
  Synthetic Oligonucleotide
gugcacaauauuuucccaucuguau

SEQ ID NO: 1342 - RNA, 25 nt, Artificial Sequence
  Synthetic Oligonucleotide
ugcacaauauuuucccaucuguauu

SEQ ID NO: 1343 - RNA, 25 nt, Artificial Sequence
  Synthetic Oligonucleotide
gcacaauauuuucccaucuguauua

SEQ ID NO: 1344 - RNA, 25 nt, Artificial Sequence
  Synthetic Oligonucleotide
cacaauauuuucccaucuguauuau

SEQ ID NO: 1345 - RNA, 25 nt, Artificial Sequence
  Synthetic Oligonucleotide
acaauauuuucccaucuguauuauu

SEQ ID NO: 1346 - RNA, 25 nt, Artificial Sequence
  Synthetic Oligonucleotide
caauauuuucccaucuguauuauuu

SEQ ID NO: 1347 - RNA, 25 nt, Artificial Sequence
  Synthetic Oligonucleotide
aauauuuucccaucuguauuauuuu

SEQ ID NO: 1348 - RNA, 25 nt, Artificial Sequence
  Synthetic Oligonucleotide
auauuuucccaucuguauuauuuuu

SEQ ID NO: 1349 - RNA, 25 nt, Artificial Sequence
  Synthetic Oligonucleotide
uauuuucccaucuguauuauuuuuu

SEQ ID NO: 1350 - RNA, 25 nt, Artificial Sequence
  Synthetic Oligonucleotide
auuuucccaucuguauuauuuuuuu

SEQ ID NO: 1351 - RNA, 25 nt, Artificial Sequence
  Synthetic Oligonucleotide
uuuuucagcauguauuacuugacaa

SEQ ID NO: 1352 - RNA, 25 nt, Artificial Sequence
  Synthetic Oligonucleotide
uuuucagcauguauuacuugacaaa

SEQ ID NO: 1353 - RNA, 25 nt, Artificial Sequence
  Synthetic Oligonucleotide
uuucagcauguauuacuugacaaag

SEQ ID NO: 1354 - RNA, 25 nt, Artificial Sequence
  Synthetic Oligonucleotide
uucagcauguauuacuugacaaaga

SEQ ID NO: 1355 - RNA, 25 nt, Artificial Sequence
  Synthetic Oligonucleotide
ucagcauguauuacuugacaaagag

SEQ ID NO: 1356 - RNA, 25 nt, Artificial Sequence
  Synthetic Oligonucleotide
cagcauguauuacuugacaaagaga

SEQ ID NO: 1357 - RNA, 25 nt, Artificial Sequence
  Synthetic Oligonucleotide
agcauguauuacuugacaaagagac

SEQ ID NO: 1358 - RNA, 25 nt, Artificial Sequence
  Synthetic Oligonucleotide
gcauguauuacuugacaaagagaca

SEQ ID NO: 1359 - RNA, 25 nt, Artificial Sequence
  Synthetic Oligonucleotide
cauguauuacuugacaaagagacac

SEQ ID NO: 1360 - RNA, 25 nt, Artificial Sequence
  Synthetic Oligonucleotide
uauuacuugacaaagagacacugug

SEQ ID NO: 1361 - RNA, 25 nt, Artificial Sequence
  Synthetic Oligonucleotide
auuacuugacaaagagacacugugc

SEQ ID NO: 1362 - RNA, 25 nt, Artificial Sequence
  Synthetic Oligonucleotide
uuacuugacaaagagacacugugca

SEQ ID NO: 1363 - RNA, 25 nt, Artificial Sequence
  Synthetic Oligonucleotide
uacuugacaaagagacacugugcag

SEQ ID NO: 1364 - RNA, 25 nt, Artificial Sequence
  Synthetic Oligonucleotide
acuugacaaagagacacugugcaga

SEQ ID NO: 1365 - RNA, 25 nt, Artificial Sequence
  Synthetic Oligonucleotide
cuugacaaagagacacugugcagag

SEQ ID NO: 1366 - RNA, 25 nt, Artificial Sequence
  Synthetic Oligonucleotide
uugacaaagagacacugugcagagg

SEQ ID NO: 1367 - RNA, 25 nt, Artificial Sequence
  Synthetic Oligonucleotide
ugacaaagagacacugugcagaggg

SEQ ID NO: 1368 - RNA, 25 nt, Artificial Sequence
  Synthetic Oligonucleotide
gacaaagagacacugugcagagggu

SEQ ID NO: 1369 - RNA, 25 nt, Artificial Sequence
  Synthetic Oligonucleotide
acaaagagacacugugcagagggug

SEQ ID NO: 1370 - RNA, 25 nt, Artificial Sequence
  Synthetic Oligonucleotide
caaagagacacugugcagaggguga

SEQ ID NO: 1371 - RNA, 25 nt, Artificial Sequence
  Synthetic Oligonucleotide
aaagagacacugugcagagggugac

SEQ ID NO: 1372 - RNA, 25 nt, Artificial Sequence
  Synthetic Oligonucleotide
aagagacacugugcagagggugacc

SEQ ID NO: 1373 - RNA, 25 nt, Artificial Sequence
  Synthetic Oligonucleotide
agagacacugugcagagggugacca

SEQ ID NO: 1374 - RNA, 25 nt, Artificial Sequence
  Synthetic Oligonucleotide
gagacacugugcagagggugaccac

SEQ ID NO: 1375 - RNA, 25 nt, Artificial Sequence
  Synthetic Oligonucleotide
agacacugugcagagggugaccaca

SEQ ID NO: 1376 - RNA, 25 nt, Artificial Sequence
  Synthetic Oligonucleotide
gacacugugcagagggugaccacag

SEQ ID NO: 1377 - RNA, 25 nt, Artificial Sequence
  Synthetic Oligonucleotide
acacugugcagagggugaccacagu

SEQ ID NO: 1378 - RNA, 25 nt, Artificial Sequence
  Synthetic Oligonucleotide
cacugugcagagggugaccacaguc

SEQ ID NO: 1379 - RNA, 25 nt, Artificial Sequence
  Synthetic Oligonucleotide
acugugcagagggugaccacagucu

SEQ ID NO: 1380 - RNA, 25 nt, Artificial Sequence
  Synthetic Oligonucleotide
cugugcagagggugaccacagucug

SEQ ID NO: 1381 - RNA, 25 nt, Artificial Sequence
  Synthetic Oligonucleotide
ugugcagagggugaccacagucugu

SEQ ID NO: 1382 - RNA, 25 nt, Artificial Sequence
  Synthetic Oligonucleotide
gugcagagggugaccacagucugua

SEQ ID NO: 1383 - RNA, 25 nt, Artificial Sequence
  Synthetic Oligonucleotide
gucuguaauuccccacuucaauaca

SEQ ID NO: 1384 - RNA, 25 nt, Artificial Sequence
  Synthetic Oligonucleotide
ucuguaauuccccacuucaauacaa

SEQ ID NO: 1385 - RNA, 25 nt, Artificial Sequence
  Synthetic Oligonucleotide
cuguaauuccccacuucaauacaaa

SEQ ID NO: 1386 - RNA, 25 nt, Artificial Sequence
  Synthetic Oligonucleotide
uguaauuccccacuucaauacaaag

SEQ ID NO: 1387 - RNA, 25 nt, Artificial Sequence
  Synthetic Oligonucleotide
auacaaagggugucguucuuuucca

SEQ ID NO: 1388 - RNA, 25 nt, Artificial Sequence
  Synthetic Oligonucleotide
uacaaagggugucguucuuuuccaa

SEQ ID NO: 1389 - RNA, 25 nt, Artificial Sequence
  Synthetic Oligonucleotide
acaaagggugucguucuuuuccaac

SEQ ID NO: 1390 - RNA, 25 nt, Artificial Sequence
  Synthetic Oligonucleotide
caaagggugucguucuuuuccaaca

SEQ ID NO: 1391 - RNA, 25 nt, Artificial Sequence
  Synthetic Oligonucleotide
aaagggugucguucuuuuccaacaa

SEQ ID NO: 1392 - RNA, 25 nt, Artificial Sequence
  Synthetic Oligonucleotide
aagggugucguucuuuuccaacaaa

SEQ ID NO: 1393 - RNA, 25 nt, Artificial Sequence
  Synthetic Oligonucleotide
agggugucguucuuuuccaacaaaa

SEQ ID NO: 1394 - RNA, 25 nt, Artificial Sequence
  Synthetic Oligonucleotide
gggugucguucuuuuccaacaaaau

SEQ ID NO: 1395 - RNA, 25 nt, Artificial Sequence
  Synthetic Oligonucleotide
ggugucguucuuuuccaacaaaaua

SEQ ID NO: 1396 - RNA, 25 nt, Artificial Sequence
  Synthetic Oligonucleotide
gugucguucuuuuccaacaaaauag

SEQ ID NO: 1397 - RNA, 25 nt, Artificial Sequence
  Synthetic Oligonucleotide
ugucguucuuuuccaacaaaauagc

SEQ ID NO: 1398 - RNA, 25 nt, Artificial Sequence
  Synthetic Oligonucleotide
gucguucuuuuccaacaaaauagca

SEQ ID NO: 1399 - RNA, 25 nt, Artificial Sequence
  Synthetic Oligonucleotide
ucguucuuuuccaacaaaauagcaa

SEQ ID NO: 1400 - RNA, 25 nt, Artificial Sequence
  Synthetic Oligonucleotide
cguucuuuuccaacaaaauagcaau

SEQ ID NO: 1401 - RNA, 25 nt, Artificial Sequence
  Synthetic Oligonucleotide
guucuuuuccaacaaaauagcaauc

SEQ ID NO: 1402 - RNA, 25 nt, Artificial Sequence
  Synthetic Oligonucleotide
uucuuuuccaacaaaauagcaaucc

SEQ ID NO: 1403 - RNA, 25 nt, Artificial Sequence
  Synthetic Oligonucleotide
ucuuuuccaacaaaauagcaauccc

SEQ ID NO: 1404 - RNA, 25 nt, Artificial Sequence
  Synthetic Oligonucleotide
caacaaaauagcaaucccuuuuauu

SEQ ID NO: 1405 - RNA, 25 nt, Artificial Sequence
  Synthetic Oligonucleotide
aacaaaauagcaaucccuuuuauuu

SEQ ID NO: 1406 - RNA, 25 nt, Artificial Sequence
  Synthetic Oligonucleotide
acaaaauagcaaucccuuuuauuuc

SEQ ID NO: 1407 - RNA, 25 nt, Artificial Sequence
  Synthetic Oligonucleotide
caaaauagcaaucccuuuuauuuca

SEQ ID NO: 1408 - RNA, 25 nt, Artificial Sequence
  Synthetic Oligonucleotide
aaaauagcaaucccuuuuauuucau

SEQ ID NO: 1409 - RNA, 25 nt, Artificial Sequence
  Synthetic Oligonucleotide
uucauugcuuuugacuuuucaaugg

SEQ ID NO: 1410 - RNA, 25 nt, Artificial Sequence
  Synthetic Oligonucleotide
ucauugcuuuugacuuuucaauggg

SEQ ID NO: 1411 - RNA, 25 nt, Artificial Sequence
  Synthetic Oligonucleotide
cauugcuuuugacuuuucaaugggu

SEQ ID NO: 1412 - RNA, 25 nt, Artificial Sequence
  Synthetic Oligonucleotide
auugcuuuugacuuuucaaugggug

SEQ ID NO: 1413 - RNA, 25 nt, Artificial Sequence
  Synthetic Oligonucleotide
uugcuuuugacuuuucaaugggugu

SEQ ID NO: 1414 - RNA, 25 nt, Artificial Sequence
  Synthetic Oligonucleotide
ugcuuuugacuuuucaauggguguc

SEQ ID NO: 1415 - RNA, 25 nt, Artificial Sequence
  Synthetic Oligonucleotide
gcuuuugacuuuucaaugggugucc

SEQ ID NO: 1416 - RNA, 25 nt, Artificial Sequence
  Synthetic Oligonucleotide
cuuuugacuuuucaauggguguccu

SEQ ID NO: 1417 - RNA, 25 nt, Artificial Sequence
  Synthetic Oligonucleotide
uuuugacuuuucaauggguguccua

SEQ ID NO: 1418 - RNA, 25 nt, Artificial Sequence
  Synthetic Oligonucleotide
uuugacuuuucaauggguguccuag

SEQ ID NO: 1419 - RNA, 25 nt, Artificial Sequence
  Synthetic Oligonucleotide
uugacuuuucaauggguguccuagg

SEQ ID NO: 1420 - RNA, 25 nt, Artificial Sequence
  Synthetic Oligonucleotide
ugacuuuucaauggguguccuagga

SEQ ID NO: 1421 - RNA, 25 nt, Artificial Sequence
  Synthetic Oligonucleotide
gacuuuucaauggguguccuaggaa

SEQ ID NO: 1422 - RNA, 25 nt, Artificial Sequence
  Synthetic Oligonucleotide
acuuuucaauggguguccuaggaac

SEQ ID NO: 1423 - RNA, 25 nt, Artificial Sequence
  Synthetic Oligonucleotide
cuuuucaauggguguccuaggaacc

SEQ ID NO: 1424 - RNA, 25 nt, Artificial Sequence
  Synthetic Oligonucleotide
uuuucaauggguguccuaggaaccu

SEQ ID NO: 1425 - RNA, 25 nt, Artificial Sequence
  Synthetic Oligonucleotide
uuucaauggguguccuaggaaccuu

SEQ ID NO: 1426 - RNA, 25 nt, Artificial Sequence
  Synthetic Oligonucleotide
uucaauggguguccuaggaaccuuu

SEQ ID NO: 1427 - RNA, 25 nt, Artificial Sequence
  Synthetic Oligonucleotide
ucaauggguguccuaggaaccuuuu

SEQ ID NO: 1428 - RNA, 25 nt, Artificial Sequence
  Synthetic Oligonucleotide
caauggguguccuaggaaccuuuua

SEQ ID NO: 1429 - RNA, 25 nt, Artificial Sequence
  Synthetic Oligonucleotide
aauggguguccuaggaaccuuuuag

SEQ ID NO: 1430 - RNA, 25 nt, Artificial Sequence
  Synthetic Oligonucleotide
auggguguccuaggaaccuuuuaga

SEQ ID NO: 1431 - RNA, 25 nt, Artificial Sequence
  Synthetic Oligonucleotide
uggguguccuaggaaccuuuuagaa

SEQ ID NO: 1432 - RNA, 25 nt, Artificial Sequence
  Synthetic Oligonucleotide
aaauggacuuucauccuggaaauau

SEQ ID NO: 1433 - RNA, 25 nt, Artificial Sequence
  Synthetic Oligonucleotide
aauggacuuucauccuggaaauaua

SEQ ID NO: 1434 - RNA, 25 nt, Artificial Sequence
  Synthetic Oligonucleotide
auggacuuucauccuggaaauauau

SEQ ID NO: 1435 - RNA, 25 nt, Artificial Sequence
  Synthetic Oligonucleotide
uggacuuucauccuggaaauauauu

SEQ ID NO: 1436 - RNA, 25 nt, Artificial Sequence
  Synthetic Oligonucleotide
ggacuuucauccuggaaauauauua

SEQ ID NO: 1437 - RNA, 25 nt, Artificial Sequence
  Synthetic Oligonucleotide
gacuuucauccuggaaauauauuaa

SEQ ID NO: 1438 - RNA, 25 nt, Artificial Sequence
  Synthetic Oligonucleotide
acuuucauccuggaaauauauuaac

SEQ ID NO: 1439 - RNA, 25 nt, Artificial Sequence
  Synthetic Oligonucleotide
cuuucauccuggaaauauauuaacu

SEQ ID NO: 1440 - RNA, 25 nt, Artificial Sequence
  Synthetic Oligonucleotide
uuucauccuggaaauauauuaacug

SEQ ID NO: 1441 - RNA, 25 nt, Artificial Sequence
  Synthetic Oligonucleotide
uucauccuggaaauauauuaacugu

SEQ ID NO: 1442 - RNA, 25 nt, Artificial Sequence
  Synthetic Oligonucleotide
ucauccuggaaauauauuaacuguu

SEQ ID NO: 1443 - RNA, 25 nt, Artificial Sequence
  Synthetic Oligonucleotide
cauccuggaaauauauuaacuguua

SEQ ID NO: 1444 - RNA, 25 nt, Artificial Sequence
  Synthetic Oligonucleotide
auccuggaaauauauuaacuguuaa

SEQ ID NO: 1445 - RNA, 25 nt, Artificial Sequence
  Synthetic Oligonucleotide
uccuggaaauauauuaacuguuaaa

SEQ ID NO: 1446 - RNA, 25 nt, Artificial Sequence
  Synthetic Oligonucleotide
ccuggaaauauauuaacuguuaaaa

SEQ ID NO: 1447 - RNA, 25 nt, Artificial Sequence
  Synthetic Oligonucleotide
cuggaaauauauuaacuguuaaaaa

SEQ ID NO: 1448 - RNA, 25 nt, Artificial Sequence
  Synthetic Oligonucleotide
uggaaauauauuaacuguuaaaaag

SEQ ID NO: 1449 - RNA, 25 nt, Artificial Sequence
  Synthetic Oligonucleotide
ggaaauauauuaacuguuaaaaaga

SEQ ID NO: 1450 - RNA, 25 nt, Artificial Sequence
  Synthetic Oligonucleotide
gaaauauauuaacuguuaaaaagaa

SEQ ID NO: 1451 - RNA, 25 nt, Artificial Sequence
  Synthetic Oligonucleotide
aaauauauuaacuguuaaaaagaaa

SEQ ID NO: 1452 - RNA, 25 nt, Artificial Sequence
  Synthetic Oligonucleotide
aauauauuaacuguuaaaaagaaaa

SEQ ID NO: 1453 - RNA, 25 nt, Artificial Sequence
  Synthetic Oligonucleotide
auauauuaacuguuaaaaagaaaac

SEQ ID NO: 1454 - RNA, 25 nt, Artificial Sequence
  Synthetic Oligonucleotide
uauauuaacuguuaaaaagaaaaca

SEQ ID NO: 1455 - RNA, 25 nt, Artificial Sequence
  Synthetic Oligonucleotide
auauuaacuguuaaaaagaaaacau

SEQ ID NO: 1456 - RNA, 25 nt, Artificial Sequence
  Synthetic Oligonucleotide
uauuaacuguuaaaaagaaaacauu

SEQ ID NO: 1457 - RNA, 25 nt, Artificial Sequence
  Synthetic Oligonucleotide
auuaacuguuaaaaagaaaacauug

SEQ ID NO: 1458 - RNA, 25 nt, Artificial Sequence
  Synthetic Oligonucleotide
uuaacuguuaaaaagaaaacauuga

SEQ ID NO: 1459 - RNA, 25 nt, Artificial Sequence
  Synthetic Oligonucleotide
uaacuguuaaaaagaaaacauugaa

SEQ ID NO: 1460 - RNA, 25 nt, Artificial Sequence
  Synthetic Oligonucleotide
aacuguuaaaaagaaaacauugaaa

SEQ ID NO: 1461 - RNA, 25 nt, Artificial Sequence
  Synthetic Oligonucleotide
acuguuaaaaagaaaacauugaaaa

SEQ ID NO: 1462 - RNA, 25 nt, Artificial Sequence
  Synthetic Oligonucleotide
cuguuaaaaagaaaacauugaaaau

SEQ ID NO: 1463 - RNA, 25 nt, Artificial Sequence
  Synthetic Oligonucleotide
uguuaaaaagaaaacauugaaaaug

SEQ ID NO: 1464 - RNA, 25 nt, Artificial Sequence
  Synthetic Oligonucleotide
guuaaaaagaaaacauugaaaaugu

SEQ ID NO: 1465 - RNA, 25 nt, Artificial Sequence
  Synthetic Oligonucleotide
uuaaaaagaaaacauugaaaaugug

SEQ ID NO: 1466 - RNA, 25 nt, Artificial Sequence
  Synthetic Oligonucleotide
caacgucauccccuggcaggcuaaa

SEQ ID NO: 1467 - RNA, 25 nt, Artificial Sequence
  Synthetic Oligonucleotide
aacgucauccccuggcaggcuaaag

SEQ ID NO: 1468 - RNA, 25 nt, Artificial Sequence
  Synthetic Oligonucleotide
acgucauccccuggcaggcuaaagu

SEQ ID NO: 1469 - RNA, 25 nt, Artificial Sequence
  Synthetic Oligonucleotide
cgucauccccuggcaggcuaaagug

SEQ ID NO: 1470 - RNA, 25 nt, Artificial Sequence
  Synthetic Oligonucleotide
gucauccccuggcaggcuaaagugc

SEQ ID NO: 1471 - RNA, 25 nt, Artificial Sequence
  Synthetic Oligonucleotide
ucauccccuggcaggcuaaagugcu

SEQ ID NO: 1472 - RNA, 25 nt, Artificial Sequence
  Synthetic Oligonucleotide
cauccccuggcaggcuaaagugcug

SEQ ID NO: 1473 - RNA, 25 nt, Artificial Sequence
  Synthetic Oligonucleotide
auccccuggcaggcuaaagugcugu

SEQ ID NO: 1474 - RNA, 25 nt, Artificial Sequence
  Synthetic Oligonucleotide
uccccuggcaggcuaaagugcugua

SEQ ID NO: 1475 - RNA, 25 nt, Artificial Sequence
  Synthetic Oligonucleotide
ccccuggcaggcuaaagugcuguau

SEQ ID NO: 1476 - RNA, 25 nt, Artificial Sequence
  Synthetic Oligonucleotide
cccuggcaggcuaaagugcuguauc

SEQ ID NO: 1477 - RNA, 25 nt, Artificial Sequence
  Synthetic Oligonucleotide
ccuggcaggcuaaagugcuguaucc

SEQ ID NO: 1478 - RNA, 25 nt, Artificial Sequence
  Synthetic Oligonucleotide
cuggcaggcuaaagugcuguauccu

SEQ ID NO: 1479 - RNA, 25 nt, Artificial Sequence
  Synthetic Oligonucleotide
guagcaaacacuaaggugaaaagau

SEQ ID NO: 1480 - RNA, 25 nt, Artificial Sequence
  Synthetic Oligonucleotide
uagcaaacacuaaggugaaaagaua

SEQ ID NO: 1481 - RNA, 25 nt, Artificial Sequence
  Synthetic Oligonucleotide
agcaaacacuaaggugaaaagauaa

SEQ ID NO: 1482 - RNA, 25 nt, Artificial Sequence
  Synthetic Oligonucleotide
gcaaacacuaaggugaaaagauaau

SEQ ID NO: 1483 - RNA, 25 nt, Artificial Sequence
  Synthetic Oligonucleotide
aaacacuaaggugaaaagauaauga

SEQ ID NO: 1484 - RNA, 25 nt, Artificial Sequence
  Synthetic Oligonucleotide
aacacuaaggugaaaagauaaugau

SEQ ID NO: 1485 - RNA, 25 nt, Artificial Sequence
  Synthetic Oligonucleotide
cuaaggugaaaagauaaugaucuca

SEQ ID NO: 1486 - RNA, 25 nt, Artificial Sequence
  Synthetic Oligonucleotide
uaaggugaaaagauaaugaucucau

SEQ ID NO: 1487 - RNA, 25 nt, Artificial Sequence
  Synthetic Oligonucleotide
aaggugaaaagauaaugaucucauu

SEQ ID NO: 1488 - RNA, 25 nt, Artificial Sequence
  Synthetic Oligonucleotide
aggugaaaagauaaugaucucauug

SEQ ID NO: 1489 - RNA, 25 nt, Artificial Sequence
  Synthetic Oligonucleotide
ggugaaaagauaaugaucucauugu

SEQ ID NO: 1490 - RNA, 25 nt, Artificial Sequence
  Synthetic Oligonucleotide
gugaaaagauaaugaucucauuguu

SEQ ID NO: 1491 - RNA, 25 nt, Artificial Sequence
  Synthetic Oligonucleotide
ugaaaagauaaugaucucauuguuu

SEQ ID NO: 1492 - RNA, 25 nt, Artificial Sequence
  Synthetic Oligonucleotide
gaaaagauaaugaucucauuguuua

SEQ ID NO: 1493 - RNA, 25 nt, Artificial Sequence
  Synthetic Oligonucleotide
aaaagauaaugaucucauuguuuau

SEQ ID NO: 1494 - RNA, 25 nt, Artificial Sequence
  Synthetic Oligonucleotide
aaagauaaugaucucauuguuuauu

SEQ ID NO: 1495 - RNA, 25 nt, Artificial Sequence
  Synthetic Oligonucleotide
aagauaaugaucucauuguuuauua

SEQ ID NO: 1496 - RNA, 25 nt, Artificial Sequence
  Synthetic Oligonucleotide
agauaaugaucucauuguuuauuaa

SEQ ID NO: 1497 - RNA, 25 nt, Artificial Sequence
  Synthetic Oligonucleotide
gauaaugaucucauuguuuauuaac

SEQ ID NO: 1498 - RNA, 25 nt, Artificial Sequence
  Synthetic Oligonucleotide
auaaugaucucauuguuuauuaacc

SEQ ID NO: 1499 - RNA, 25 nt, Artificial Sequence
  Synthetic Oligonucleotide
uaaugaucucauuguuuauuaaccu

SEQ ID NO: 1500 - RNA, 25 nt, Artificial Sequence
  Synthetic Oligonucleotide
aaugaucucauuguuuauuaaccug

SEQ ID NO: 1501 - RNA, 25 nt, Artificial Sequence
  Synthetic Oligonucleotide
augaucucauuguuuauuaaccugu

SEQ ID NO: 1502 - RNA, 25 nt, Artificial Sequence
  Synthetic Oligonucleotide
ugaucucauuguuuauuaaccugua

SEQ ID NO: 1503 - RNA, 25 nt, Artificial Sequence
  Synthetic Oligonucleotide
gaucucauuguuuauuaaccuguau

SEQ ID NO: 1504 - RNA, 25 nt, Artificial Sequence
  Synthetic Oligonucleotide
aucucauuguuuauuaaccuguauu

SEQ ID NO: 1505 - RNA, 25 nt, Artificial Sequence
  Synthetic Oligonucleotide
ucucauuguuuauuaaccuguauuc

SEQ ID NO: 1506 - RNA, 25 nt, Artificial Sequence
  Synthetic Oligonucleotide
cucauuguuuauuaaccuguauucu

SEQ ID NO: 1507 - RNA, 25 nt, Artificial Sequence
  Synthetic Oligonucleotide
ucauuguuuauuaaccuguauucug

SEQ ID NO: 1508 - RNA, 25 nt, Artificial Sequence
  Synthetic Oligonucleotide
cauuguuuauuaaccuguauucugu

SEQ ID NO: 1509 - RNA, 25 nt, Artificial Sequence
  Synthetic Oligonucleotide
auuguuuauuaaccuguauucuguu

SEQ ID NO: 1510 - RNA, 25 nt, Artificial Sequence
  Synthetic Oligonucleotide
guuuauuaaccuguauucuguuuac

SEQ ID NO: 1511 - RNA, 25 nt, Artificial Sequence
  Synthetic Oligonucleotide
uuuauuaaccuguauucuguuuaca

SEQ ID NO: 1512 - RNA, 25 nt, Artificial Sequence
  Synthetic Oligonucleotide
auuaaccuguauucuguuuacaugu

SEQ ID NO: 1513 - RNA, 25 nt, Artificial Sequence
  Synthetic Oligonucleotide
uuaaccuguauucuguuuacauguc

SEQ ID NO: 1514 - RNA, 25 nt, Artificial Sequence
  Synthetic Oligonucleotide
uuaaaacagugguucuuaaauugua

SEQ ID NO: 1515 - RNA, 25 nt, Artificial Sequence
  Synthetic Oligonucleotide
uaaaacagugguucuuaaauuguaa

SEQ ID NO: 1516 - RNA, 25 nt, Artificial Sequence
  Synthetic Oligonucleotide
aaaacagugguucuuaaauuguaag

SEQ ID NO: 1517 - RNA, 25 nt, Artificial Sequence
  Synthetic Oligonucleotide
aaacagugguucuuaaauuguaagc

SEQ ID NO: 1518 - RNA, 25 nt, Artificial Sequence
  Synthetic Oligonucleotide
aacagugguucuuaaauuguaagcu

SEQ ID NO: 1519 - RNA, 25 nt, Artificial Sequence
  Synthetic Oligonucleotide
acagugguucuuaaauuguaagcuc

SEQ ID NO: 1520 - RNA, 25 nt, Artificial Sequence
  Synthetic Oligonucleotide
cagugguucuuaaauuguaagcuca

SEQ ID NO: 1521 - RNA, 25 nt, Artificial Sequence
  Synthetic Oligonucleotide
guucuuaaauuguaagcucagguuc

SEQ ID NO: 1522 - RNA, 25 nt, Artificial Sequence
  Synthetic Oligonucleotide
cuuaaauuguaagcucagguucaaa

SEQ ID NO: 1523 - RNA, 25 nt, Artificial Sequence
  Synthetic Oligonucleotide
uuaaauuguaagcucagguucaaag

SEQ ID NO: 1524 - RNA, 25 nt, Artificial Sequence
  Synthetic Oligonucleotide
aaauuguaagcucagguucaaagug

SEQ ID NO: 1525 - RNA, 25 nt, Artificial Sequence
  Synthetic Oligonucleotide
aauuguaagcucagguucaaagugu

SEQ ID NO: 1526 - RNA, 25 nt, Artificial Sequence
  Synthetic Oligonucleotide
auuguaagcucagguucaaaguguu

SEQ ID NO: 1527 - RNA, 25 nt, Artificial Sequence
  Synthetic Oligonucleotide
ggugauacuucuuugaauguagauu

SEQ ID NO: 1528 - RNA, 25 nt, Artificial Sequence
  Synthetic Oligonucleotide
aucacaucuuuagugucugaauaua

SEQ ID NO: 1529 - RNA, 25 nt, Artificial Sequence
  Synthetic Oligonucleotide
uagugucugaauauauccaaauguu

SEQ ID NO: 1530 - RNA, 25 nt, Artificial Sequence
  Synthetic Oligonucleotide
agugucugaauauauccaaauguuu

SEQ ID NO: 1531 - RNA, 25 nt, Artificial Sequence
  Synthetic Oligonucleotide
gugucugaauauauccaaauguuuu

SEQ ID NO: 1532 - RNA, 25 nt, Artificial Sequence
  Synthetic Oligonucleotide
gucugaauauauccaaauguuuuag

SEQ ID NO: 1533 - RNA, 25 nt, Artificial Sequence
  Synthetic Oligonucleotide
ucugaauauauccaaauguuuuagg

SEQ ID NO: 1534 - RNA, 25 nt, Artificial Sequence
  Synthetic Oligonucleotide
cugaauauauccaaauguuuuagga

SEQ ID NO: 1535 - RNA, 25 nt, Artificial Sequence
  Synthetic Oligonucleotide
ugaauauauccaaauguuuuaggau

SEQ ID NO: 1536 - RNA, 25 nt, Artificial Sequence
  Synthetic Oligonucleotide
gaauauauccaaauguuuuaggaug

SEQ ID NO: 1537 - RNA, 21 nt, Artificial Sequence
  Synthetic Oligonucleotide
ccggcuaauuuguaucaauga

SEQ ID NO: 1538 - RNA, 21 nt, Artificial Sequence
  Synthetic Oligonucleotide
cggcuaauuuguaucaaugau

SEQ ID NO: 1539 - RNA, 21 nt, Artificial Sequence
  Synthetic Oligonucleotide
ggcuaauuuguaucaaugauu

SEQ ID NO: 1540 - RNA, 21 nt, Artificial Sequence
  Synthetic Oligonucleotide
gcuaauuuguaucaaugauua

SEQ ID NO: 1541 - RNA, 21 nt, Artificial Sequence
  Synthetic Oligonucleotide
cuaauuuguaucaaugauuau

SEQ ID NO: 1542 - RNA, 21 nt, Artificial Sequence
  Synthetic Oligonucleotide
uaauuuguaucaaugauuaug

SEQ ID NO: 1543 - RNA, 21 nt, Artificial Sequence
  Synthetic Oligonucleotide
aauuuguaucaaugauuauga

SEQ ID NO: 1544 - RNA, 21 nt, Artificial Sequence
  Synthetic Oligonucleotide
auuuguaucaaugauuaugaa

SEQ ID NO: 1545 - RNA, 21 nt, Artificial Sequence
  Synthetic Oligonucleotide
uuuguaucaaugauuaugaac

SEQ ID NO: 1546 - RNA, 21 nt, Artificial Sequence
  Synthetic Oligonucleotide
uuguaucaaugauuaugaaca

SEQ ID NO: 1547 - RNA, 21 nt, Artificial Sequence
  Synthetic Oligonucleotide
guaucaaugauuaugaacaac

SEQ ID NO: 1548 - RNA, 21 nt, Artificial Sequence
  Synthetic Oligonucleotide
uaucaaugauuaugaacaaca

SEQ ID NO: 1549 - RNA, 21 nt, Artificial Sequence
  Synthetic Oligonucleotide
aucaaugauuaugaacaacau

SEQ ID NO: 1550 - RNA, 21 nt, Artificial Sequence
  Synthetic Oligonucleotide
ucaaugauuaugaacaacaug

SEQ ID NO: 1551 - RNA, 21 nt, Artificial Sequence
  Synthetic Oligonucleotide
caaugauuaugaacaacaugc

SEQ ID NO: 1552 - RNA, 21 nt, Artificial Sequence
  Synthetic Oligonucleotide
aaugauuaugaacaacaugcu

SEQ ID NO: 1553 - RNA, 21 nt, Artificial Sequence
  Synthetic Oligonucleotide
augauuaugaacaacaugcua

SEQ ID NO: 1554 - RNA, 21 nt, Artificial Sequence
  Synthetic Oligonucleotide
ugauuaugaacaacaugcuaa

SEQ ID NO: 1555 - RNA, 21 nt, Artificial Sequence
  Synthetic Oligonucleotide
uuaugaacaacaugcuaaauc

SEQ ID NO: 1556 - RNA, 21 nt, Artificial Sequence
  Synthetic Oligonucleotide
augaacaacaugcuaaaucag

SEQ ID NO: 1557 - RNA, 21 nt, Artificial Sequence
  Synthetic Oligonucleotide
ugaacaacaugcuaaaucagu

SEQ ID NO: 1558 - RNA, 21 nt, Artificial Sequence
  Synthetic Oligonucleotide
acaacaugcuaaaucaguacu

SEQ ID NO: 1559 - RNA, 21 nt, Artificial Sequence
  Synthetic Oligonucleotide
uaaaucaguacuuccaaaguc

SEQ ID NO: 1560 - RNA, 21 nt, Artificial Sequence
  Synthetic Oligonucleotide
aaaucaguacuuccaaagucu

SEQ ID NO: 1561 - RNA, 21 nt, Artificial Sequence
  Synthetic Oligonucleotide
aucaguacuuccaaagucuau

SEQ ID NO: 1562 - RNA, 21 nt, Artificial Sequence
  Synthetic Oligonucleotide
ucaguacuuccaaagucuaua

SEQ ID NO: 1563 - RNA, 21 nt, Artificial Sequence
  Synthetic Oligonucleotide
caguacuuccaaagucuauau

SEQ ID NO: 1564 - RNA, 21 nt, Artificial Sequence
  Synthetic Oligonucleotide
uacuuccaaagucuauauaug

SEQ ID NO: 1565 - RNA, 21 nt, Artificial Sequence
  Synthetic Oligonucleotide
uuccaaagucuauauaugacu

SEQ ID NO: 1566 - RNA, 21 nt, Artificial Sequence
  Synthetic Oligonucleotide
uccaaagucuauauaugacua

SEQ ID NO: 1567 - RNA, 21 nt, Artificial Sequence
  Synthetic Oligonucleotide
caaagucuauauaugacuauu

SEQ ID NO: 1568 - RNA, 21 nt, Artificial Sequence
  Synthetic Oligonucleotide
uauaugacuauuacaggucug

SEQ ID NO: 1569 - RNA, 21 nt, Artificial Sequence
  Synthetic Oligonucleotide
auaugacuauuacaggucugg

SEQ ID NO: 1570 - RNA, 21 nt, Artificial Sequence
  Synthetic Oligonucleotide
uaugacuauuacaggucuggg

SEQ ID NO: 1571 - RNA, 21 nt, Artificial Sequence
  Synthetic Oligonucleotide
augacuauuacaggucugggg

SEQ ID NO: 1572 - RNA, 21 nt, Artificial Sequence
  Synthetic Oligonucleotide
ugacuauuacaggucuggggc

SEQ ID NO: 1573 - RNA, 21 nt, Artificial Sequence
  Synthetic Oligonucleotide
gacuauuacaggucuggggca

SEQ ID NO: 1574 - RNA, 21 nt, Artificial Sequence
  Synthetic Oligonucleotide
acuauuacaggucuggggcaa

SEQ ID NO: 1575 - RNA, 21 nt, Artificial Sequence
  Synthetic Oligonucleotide
cuauuacaggucuggggcaaa

SEQ ID NO: 1576 - RNA, 21 nt, Artificial Sequence
  Synthetic Oligonucleotide
uauuacaggucuggggcaaau

SEQ ID NO: 1577 - RNA, 21 nt, Artificial Sequence
  Synthetic Oligonucleotide
auuacaggucuggggcaaaug

SEQ ID NO: 1578 - RNA, 21 nt, Artificial Sequence
  Synthetic Oligonucleotide
uuacaggucuggggcaaauga

SEQ ID NO: 1579 - RNA, 21 nt, Artificial Sequence
  Synthetic Oligonucleotide
uacaggucuggggcaaaugau

SEQ ID NO: 1580 - RNA, 21 nt, Artificial Sequence
  Synthetic Oligonucleotide
ccggaauguugcugaaacaga

SEQ ID NO: 1581 - RNA, 21 nt, Artificial Sequence
  Synthetic Oligonucleotide
cgacuucuguuuuaggacaga

SEQ ID NO: 1582 - RNA, 21 nt, Artificial Sequence
  Synthetic Oligonucleotide
gacuucuguuuuaggacagag

SEQ ID NO: 1583 - RNA, 21 nt, Artificial Sequence
  Synthetic Oligonucleotide
gcuacaaggccauauuuguga

SEQ ID NO: 1584 - RNA, 21 nt, Artificial Sequence
  Synthetic Oligonucleotide
cuacaaggccauauuugugac

SEQ ID NO: 1585 - RNA, 21 nt, Artificial Sequence
  Synthetic Oligonucleotide
cgccacaacucaggaugaaaa

SEQ ID NO: 1586 - RNA, 21 nt, Artificial Sequence
  Synthetic Oligonucleotide
gccacaacucaggaugaaaaa

SEQ ID NO: 1587 - RNA, 21 nt, Artificial Sequence
  Synthetic Oligonucleotide
ccacaacucaggaugaaaaau

SEQ ID NO: 1588 - RNA, 21 nt, Artificial Sequence
  Synthetic Oligonucleotide
cacaacucaggaugaaaaauu

SEQ ID NO: 1589 - RNA, 21 nt, Artificial Sequence
  Synthetic Oligonucleotide
acaacucaggaugaaaaauuu

SEQ ID NO: 1590 - RNA, 21 nt, Artificial Sequence
  Synthetic Oligonucleotide
aacucaggaugaaaaauuuug

SEQ ID NO: 1591 - RNA, 21 nt, Artificial Sequence
  Synthetic Oligonucleotide
acucaggaugaaaaauuuuga

SEQ ID NO: 1592 - RNA, 21 nt, Artificial Sequence
  Synthetic Oligonucleotide
cucaggaugaaaaauuuugaa

SEQ ID NO: 1593 - RNA, 21 nt, Artificial Sequence
  Synthetic Oligonucleotide
ucaggaugaaaaauuuugaaa

SEQ ID NO: 1594 - RNA, 21 nt, Artificial Sequence
  Synthetic Oligonucleotide
aggaugaaaaauuuugaaacc

SEQ ID NO: 1595 - RNA, 21 nt, Artificial Sequence
  Synthetic Oligonucleotide
ggaugaaaaauuuugaaacca

SEQ ID NO: 1596 - RNA, 21 nt, Artificial Sequence
  Synthetic Oligonucleotide
gaugaaaaauuuugaaaccag

SEQ ID NO: 1597 - RNA, 21 nt, Artificial Sequence
  Synthetic Oligonucleotide
augaaaaauuuugaaaccagu

SEQ ID NO: 1598 - RNA, 21 nt, Artificial Sequence
  Synthetic Oligonucleotide
ugaaaaauuuugaaaccagua

SEQ ID NO: 1599 - RNA, 21 nt, Artificial Sequence
  Synthetic Oligonucleotide
gaaaaauuuugaaaccaguac

SEQ ID NO: 1600 - RNA, 21 nt, Artificial Sequence
  Synthetic Oligonucleotide
aaaaauuuugaaaccaguacu

SEQ ID NO: 1601 - RNA, 21 nt, Artificial Sequence
  Synthetic Oligonucleotide
aaaauuuugaaaccaguacuu

SEQ ID NO: 1602 - RNA, 21 nt, Artificial Sequence
  Synthetic Oligonucleotide
aaauuuugaaaccaguacuuu

SEQ ID NO: 1603 - RNA, 21 nt, Artificial Sequence
  Synthetic Oligonucleotide
aauuuugaaaccaguacuuua

SEQ ID NO: 1604 - RNA, 21 nt, Artificial Sequence
  Synthetic Oligonucleotide
auuuugaaaccaguacuuuau

SEQ ID NO: 1605 - RNA, 21 nt, Artificial Sequence
  Synthetic Oligonucleotide
uuuugaaaccaguacuuuauc

SEQ ID NO: 1606 - RNA, 21 nt, Artificial Sequence
  Synthetic Oligonucleotide
uuugaaaccaguacuuuauca

SEQ ID NO: 1607 - RNA, 21 nt, Artificial Sequence
  Synthetic Oligonucleotide
uugaaaccaguacuuuaucau

SEQ ID NO: 1608 - RNA, 21 nt, Artificial Sequence
  Synthetic Oligonucleotide
ugaaaccaguacuuuaucauu

SEQ ID NO: 1609 - RNA, 21 nt, Artificial Sequence
  Synthetic Oligonucleotide
gaaaccaguacuuuaucauuu

SEQ ID NO: 1610 - RNA, 21 nt, Artificial Sequence
  Synthetic Oligonucleotide
aaccaguacuuuaucauuuuc

SEQ ID NO: 1611 - RNA, 21 nt, Artificial Sequence
  Synthetic Oligonucleotide
accaguacuuuaucauuuucu

SEQ ID NO: 1612 - RNA, 21 nt, Artificial Sequence
  Synthetic Oligonucleotide
uuaucauuuucuccugaggaa

SEQ ID NO: 1613 - RNA, 21 nt, Artificial Sequence
  Synthetic Oligonucleotide
caaauggcugagaagacugac

SEQ ID NO: 1614 - RNA, 21 nt, Artificial Sequence
  Synthetic Oligonucleotide
gcaaagggcauuuugagaggu

SEQ ID NO: 1615 - RNA, 21 nt, Artificial Sequence
  Synthetic Oligonucleotide
caaagggcauuuugagaggug

SEQ ID NO: 1616 - RNA, 21 nt, Artificial Sequence
  Synthetic Oligonucleotide
aaagggcauuuugagagguga

SEQ ID NO: 1617 - RNA, 21 nt, Artificial Sequence
  Synthetic Oligonucleotide
aagggcauuuugagaggugau

SEQ ID NO: 1618 - RNA, 21 nt, Artificial Sequence
  Synthetic Oligonucleotide
agggcauuuugagaggugaug

SEQ ID NO: 1619 - RNA, 21 nt, Artificial Sequence
  Synthetic Oligonucleotide
gggcauuuugagaggugauga

SEQ ID NO: 1620 - RNA, 21 nt, Artificial Sequence
  Synthetic Oligonucleotide
ggcauuuugagaggugaugau

SEQ ID NO: 1621 - RNA, 21 nt, Artificial Sequence
  Synthetic Oligonucleotide
gcauuuugagaggugaugaug

SEQ ID NO: 1622 - RNA, 21 nt, Artificial Sequence
  Synthetic Oligonucleotide
cauuuugagaggugaugaugc

SEQ ID NO: 1623 - RNA, 21 nt, Artificial Sequence
  Synthetic Oligonucleotide
auuuugagaggugaugaugcc

SEQ ID NO: 1624 - RNA, 21 nt, Artificial Sequence
  Synthetic Oligonucleotide
uuuugagaggugaugaugcca

SEQ ID NO: 1625 - RNA, 21 nt, Artificial Sequence
  Synthetic Oligonucleotide
gaaugggaucuuggugucgaa

SEQ ID NO: 1626 - RNA, 21 nt, Artificial Sequence
  Synthetic Oligonucleotide
aaugggaucuuggugucgaau

SEQ ID NO: 1627 - RNA, 21 nt, Artificial Sequence
  Synthetic Oligonucleotide
augggaucuuggugucgaauc

SEQ ID NO: 1628 - RNA, 21 nt, Artificial Sequence
  Synthetic Oligonucleotide
ugggaucuuggugucgaauca

SEQ ID NO: 1629 - RNA, 21 nt, Artificial Sequence
  Synthetic Oligonucleotide
gggaucuuggugucgaaucau

SEQ ID NO: 1630 - RNA, 21 nt, Artificial Sequence
  Synthetic Oligonucleotide
ggaucuuggugucgaaucaug

SEQ ID NO: 1631 - RNA, 21 nt, Artificial Sequence
  Synthetic Oligonucleotide
gaucuuggugucgaaucaugg

SEQ ID NO: 1632 - RNA, 21 nt, Artificial Sequence
  Synthetic Oligonucleotide
aucuuggugucgaaucauggg

SEQ ID NO: 1633 - RNA, 21 nt, Artificial Sequence
  Synthetic Oligonucleotide
ucuuggugucgaaucaugggg

SEQ ID NO: 1634 - RNA, 21 nt, Artificial Sequence
  Synthetic Oligonucleotide
cuuggugucgaaucauggggc

SEQ ID NO: 1635 - RNA, 21 nt, Artificial Sequence
  Synthetic Oligonucleotide
agccacuauugauguucugcc

SEQ ID NO: 1636 - RNA, 21 nt, Artificial Sequence
  Synthetic Oligonucleotide
cacuauugauguucugccaga

SEQ ID NO: 1637 - RNA, 21 nt, Artificial Sequence
  Synthetic Oligonucleotide
acuauugauguucugccagaa

SEQ ID NO: 1638 - RNA, 21 nt, Artificial Sequence
  Synthetic Oligonucleotide
uggaggcuguggaagggaagg

SEQ ID NO: 1639 - RNA, 21 nt, Artificial Sequence
  Synthetic Oligonucleotide
ggaggcuguggaagggaaggu

SEQ ID NO: 1640 - RNA, 21 nt, Artificial Sequence
  Synthetic Oligonucleotide
ggggagaaagguguucaagau

SEQ ID NO: 1641 - RNA, 21 nt, Artificial Sequence
  Synthetic Oligonucleotide
gggagaaagguguucaagaug

SEQ ID NO: 1642 - RNA, 21 nt, Artificial Sequence
  Synthetic Oligonucleotide
ggagaaagguguucaagaugu

SEQ ID NO: 1643 - RNA, 21 nt, Artificial Sequence
  Synthetic Oligonucleotide
gagaaagguguucaagauguc

SEQ ID NO: 1644 - RNA, 21 nt, Artificial Sequence
  Synthetic Oligonucleotide
agaaagguguucaagaugucc

SEQ ID NO: 1645 - RNA, 21 nt, Artificial Sequence
  Synthetic Oligonucleotide
gaaagguguucaagauguccu

SEQ ID NO: 1646 - RNA, 21 nt, Artificial Sequence
  Synthetic Oligonucleotide
aaagguguucaagauguccuc

SEQ ID NO: 1647 - RNA, 21 nt, Artificial Sequence
  Synthetic Oligonucleotide
aagguguucaagauguccucg

SEQ ID NO: 1648 - RNA, 21 nt, Artificial Sequence
  Synthetic Oligonucleotide
agguguucaagauguccucga

SEQ ID NO: 1649 - RNA, 21 nt, Artificial Sequence
  Synthetic Oligonucleotide
gguguucaagauguccucgag

SEQ ID NO: 1650 - RNA, 21 nt, Artificial Sequence
  Synthetic Oligonucleotide
guguucaagauguccucgaga

SEQ ID NO: 1651 - RNA, 21 nt, Artificial Sequence
  Synthetic Oligonucleotide
uguucaagauguccucgagau

SEQ ID NO: 1652 - RNA, 21 nt, Artificial Sequence
  Synthetic Oligonucleotide
guucaagauguccucgagaua

SEQ ID NO: 1653 - RNA, 21 nt, Artificial Sequence
  Synthetic Oligonucleotide
guuggccauggcucugagugg

SEQ ID NO: 1654 - RNA, 21 nt, Artificial Sequence
  Synthetic Oligonucleotide
uuggccauggcucugaguggg

SEQ ID NO: 1655 - RNA, 21 nt, Artificial Sequence
  Synthetic Oligonucleotide
uggccauggcucugagugggu

SEQ ID NO: 1656 - RNA, 21 nt, Artificial Sequence
  Synthetic Oligonucleotide
ggccauggcucugagugggug

SEQ ID NO: 1657 - RNA, 21 nt, Artificial Sequence
  Synthetic Oligonucleotide
gccauggcucugagugggugc

SEQ ID NO: 1658 - RNA, 21 nt, Artificial Sequence
  Synthetic Oligonucleotide
ccauggcucugagugggugcc

SEQ ID NO: 1659 - RNA, 21 nt, Artificial Sequence
  Synthetic Oligonucleotide
cauggcucugagugggugcca

SEQ ID NO: 1660 - RNA, 21 nt, Artificial Sequence
  Synthetic Oligonucleotide
auggcucugagugggugccag

SEQ ID NO: 1661 - RNA, 21 nt, Artificial Sequence
  Synthetic Oligonucleotide
uggcucugagugggugccaga

SEQ ID NO: 1662 - RNA, 21 nt, Artificial Sequence
  Synthetic Oligonucleotide
ggcucugagugggugccagaa

SEQ ID NO: 1663 - RNA, 21 nt, Artificial Sequence
  Synthetic Oligonucleotide
gcucugagugggugccagaau

SEQ ID NO: 1664 - RNA, 21 nt, Artificial Sequence
  Synthetic Oligonucleotide
cucugagugggugccagaaug

SEQ ID NO: 1665 - RNA, 21 nt, Artificial Sequence
  Synthetic Oligonucleotide
ucugagugggugccagaaugu

SEQ ID NO: 1666 - RNA, 21 nt, Artificial Sequence
  Synthetic Oligonucleotide
cugagugggugccagaaugug

SEQ ID NO: 1667 - RNA, 21 nt, Artificial Sequence
  Synthetic Oligonucleotide
ugagugggugccagaauguga

SEQ ID NO: 1668 - RNA, 21 nt, Artificial Sequence
  Synthetic Oligonucleotide
gagugggugccagaaugugaa

SEQ ID NO: 1669 - RNA, 21 nt, Artificial Sequence
  Synthetic Oligonucleotide
agugggugccagaaugugaaa

SEQ ID NO: 1670 - RNA, 21 nt, Artificial Sequence
  Synthetic Oligonucleotide
gugggugccagaaugugaaag

SEQ ID NO: 1671 - RNA, 21 nt, Artificial Sequence
  Synthetic Oligonucleotide
ugggugccagaaugugaaagu

SEQ ID NO: 1672 - RNA, 21 nt, Artificial Sequence
  Synthetic Oligonucleotide
gggugccagaaugugaaaguc

SEQ ID NO: 1673 - RNA, 21 nt, Artificial Sequence
  Synthetic Oligonucleotide
ggugccagaaugugaaaguca

SEQ ID NO: 1674 - RNA, 21 nt, Artificial Sequence
  Synthetic Oligonucleotide
gugccagaaugugaaagucau

SEQ ID NO: 1675 - RNA, 21 nt, Artificial Sequence
  Synthetic Oligonucleotide
ugccagaaugugaaagucauc

SEQ ID NO: 1676 - RNA, 21 nt, Artificial Sequence
  Synthetic Oligonucleotide
gccagaaugugaaagucaucg

SEQ ID NO: 1677 - RNA, 21 nt, Artificial Sequence
  Synthetic Oligonucleotide
ccagaaugugaaagucaucga

SEQ ID NO: 1678 - RNA, 21 nt, Artificial Sequence
  Synthetic Oligonucleotide
cagaaugugaaagucaucgac

SEQ ID NO: 1679 - RNA, 21 nt, Artificial Sequence
  Synthetic Oligonucleotide
agaaugugaaagucaucgaca

SEQ ID NO: 1680 - RNA, 21 nt, Artificial Sequence
  Synthetic Oligonucleotide
gaaugugaaagucaucgacaa

SEQ ID NO: 1681 - RNA, 21 nt, Artificial Sequence
  Synthetic Oligonucleotide
aaugugaaagucaucgacaag

SEQ ID NO: 1682 - RNA, 21 nt, Artificial Sequence
  Synthetic Oligonucleotide
augugaaagucaucgacaaga

SEQ ID NO: 1683 - RNA, 21 nt, Artificial Sequence
  Synthetic Oligonucleotide
ugugaaagucaucgacaagac

SEQ ID NO: 1684 - RNA, 21 nt, Artificial Sequence
  Synthetic Oligonucleotide
gugaaagucaucgacaagaca

SEQ ID NO: 1685 - RNA, 21 nt, Artificial Sequence
  Synthetic Oligonucleotide
ugaaagucaucgacaagacau

SEQ ID NO: 1686 - RNA, 21 nt, Artificial Sequence
  Synthetic Oligonucleotide
gaaagucaucgacaagacauu

SEQ ID NO: 1687 - RNA, 21 nt, Artificial Sequence
  Synthetic Oligonucleotide
aaagucaucgacaagacauug

SEQ ID NO: 1688 - RNA, 21 nt, Artificial Sequence
  Synthetic Oligonucleotide
aagucaucgacaagacauugg

SEQ ID NO: 1689 - RNA, 21 nt, Artificial Sequence
  Synthetic Oligonucleotide
agucaucgacaagacauuggu

SEQ ID NO: 1690 - RNA, 21 nt, Artificial Sequence
  Synthetic Oligonucleotide
gucaucgacaagacauuggug

SEQ ID NO: 1691 - RNA, 21 nt, Artificial Sequence
  Synthetic Oligonucleotide
ucaucgacaagacauugguga

SEQ ID NO: 1692 - RNA, 21 nt, Artificial Sequence
  Synthetic Oligonucleotide
caucgacaagacauuggugag

SEQ ID NO: 1693 - RNA, 21 nt, Artificial Sequence
  Synthetic Oligonucleotide
aucgacaagacauuggugagg

SEQ ID NO: 1694 - RNA, 21 nt, Artificial Sequence
  Synthetic Oligonucleotide
ucgacaagacauuggugagga

SEQ ID NO: 1695 - RNA, 21 nt, Artificial Sequence
  Synthetic Oligonucleotide
cgacaagacauuggugaggaa

SEQ ID NO: 1696 - RNA, 21 nt, Artificial Sequence
  Synthetic Oligonucleotide
gacaagacauuggugaggaaa

SEQ ID NO: 1697 - RNA, 21 nt, Artificial Sequence
  Synthetic Oligonucleotide
acaagacauuggugaggaaaa

SEQ ID NO: 1698 - RNA, 21 nt, Artificial Sequence
  Synthetic Oligonucleotide
caagacauuggugaggaaaaa

SEQ ID NO: 1699 - RNA, 21 nt, Artificial Sequence
  Synthetic Oligonucleotide
aagacauuggugaggaaaaau

SEQ ID NO: 1700 - RNA, 21 nt, Artificial Sequence
  Synthetic Oligonucleotide
agacauuggugaggaaaaauc

SEQ ID NO: 1701 - RNA, 21 nt, Artificial Sequence
  Synthetic Oligonucleotide
gacauuggugaggaaaaaucc

SEQ ID NO: 1702 - RNA, 21 nt, Artificial Sequence
  Synthetic Oligonucleotide
acauuggugaggaaaaauccu

SEQ ID NO: 1703 - RNA, 21 nt, Artificial Sequence
  Synthetic Oligonucleotide
cauuggugaggaaaaauccuu

SEQ ID NO: 1704 - RNA, 21 nt, Artificial Sequence
  Synthetic Oligonucleotide
auuggugaggaaaaauccuuu

SEQ ID NO: 1705 - RNA, 21 nt, Artificial Sequence
  Synthetic Oligonucleotide
uuggugaggaaaaauccuuug

SEQ ID NO: 1706 - RNA, 21 nt, Artificial Sequence
  Synthetic Oligonucleotide
uggugaggaaaaauccuuugg

SEQ ID NO: 1707 - RNA, 21 nt, Artificial Sequence
  Synthetic Oligonucleotide
ggugaggaaaaauccuuuggc

SEQ ID NO: 1708 - RNA, 21 nt, Artificial Sequence
  Synthetic Oligonucleotide
ccguuuccaagaucugacagu

SEQ ID NO: 1709 - RNA, 21 nt, Artificial Sequence
  Synthetic Oligonucleotide
cguuuccaagaucugacagug

SEQ ID NO: 1710 - RNA, 21 nt, Artificial Sequence
  Synthetic Oligonucleotide
guuuccaagaucugacagugc

SEQ ID NO: 1711 - RNA, 21 nt, Artificial Sequence
  Synthetic Oligonucleotide
uuuccaagaucugacagugca

SEQ ID NO: 1712 - RNA, 21 nt, Artificial Sequence
  Synthetic Oligonucleotide
uuccaagaucugacagugcac

SEQ ID NO: 1713 - RNA, 21 nt, Artificial Sequence
  Synthetic Oligonucleotide
uccaagaucugacagugcaca

SEQ ID NO: 1714 - RNA, 21 nt, Artificial Sequence
  Synthetic Oligonucleotide
ccaagaucugacagugcacaa

SEQ ID NO: 1715 - RNA, 21 nt, Artificial Sequence
  Synthetic Oligonucleotide
caagaucugacagugcacaau

SEQ ID NO: 1716 - RNA, 21 nt, Artificial Sequence
  Synthetic Oligonucleotide
aagaucugacagugcacaaua

SEQ ID NO: 1717 - RNA, 21 nt, Artificial Sequence
  Synthetic Oligonucleotide
agaucugacagugcacaauau

SEQ ID NO: 1718 - RNA, 21 nt, Artificial Sequence
  Synthetic Oligonucleotide
gaucugacagugcacaauauu

SEQ ID NO: 1719 - RNA, 21 nt, Artificial Sequence
  Synthetic Oligonucleotide
aucugacagugcacaauauuu

SEQ ID NO: 1720 - RNA, 21 nt, Artificial Sequence
  Synthetic Oligonucleotide
ucugacagugcacaauauuuu

SEQ ID NO: 1721 - RNA, 21 nt, Artificial Sequence
  Synthetic Oligonucleotide
cugacagugcacaauauuuuc

SEQ ID NO: 1722 - RNA, 21 nt, Artificial Sequence
  Synthetic Oligonucleotide
ugacagugcacaauauuuucc

SEQ ID NO: 1723 - RNA, 21 nt, Artificial Sequence
  Synthetic Oligonucleotide
gacagugcacaauauuuuccc

SEQ ID NO: 1724 - RNA, 21 nt, Artificial Sequence
  Synthetic Oligonucleotide
acagugcacaauauuuuccca

SEQ ID NO: 1725 - RNA, 21 nt, Artificial Sequence
  Synthetic Oligonucleotide
cagugcacaauauuuucccau

SEQ ID NO: 1726 - RNA, 21 nt, Artificial Sequence
  Synthetic Oligonucleotide
agugcacaauauuuucccauc

SEQ ID NO: 1727 - RNA, 21 nt, Artificial Sequence
  Synthetic Oligonucleotide
gugcacaauauuuucccaucu

SEQ ID NO: 1728 - RNA, 21 nt, Artificial Sequence
  Synthetic Oligonucleotide
ugcacaauauuuucccaucug

SEQ ID NO: 1729 - RNA, 21 nt, Artificial Sequence
  Synthetic Oligonucleotide
gcacaauauuuucccaucugu

SEQ ID NO: 1730 - RNA, 21 nt, Artificial Sequence
  Synthetic Oligonucleotide
cacaauauuuucccaucugua

SEQ ID NO: 1731 - RNA, 21 nt, Artificial Sequence
  Synthetic Oligonucleotide
acaauauuuucccaucuguau

SEQ ID NO: 1732 - RNA, 21 nt, Artificial Sequence
  Synthetic Oligonucleotide
caauauuuucccaucuguauu

SEQ ID NO: 1733 - RNA, 21 nt, Artificial Sequence
  Synthetic Oligonucleotide
aauauuuucccaucuguauua

SEQ ID NO: 1734 - RNA, 21 nt, Artificial Sequence
  Synthetic Oligonucleotide
auauuuucccaucuguauuau

SEQ ID NO: 1735 - RNA, 21 nt, Artificial Sequence
  Synthetic Oligonucleotide
uuuuuuucagcauguauuacu

SEQ ID NO: 1736 - RNA, 21 nt, Artificial Sequence
  Synthetic Oligonucleotide
uuuuuucagcauguauuacuu

SEQ ID NO: 1737 - RNA, 21 nt, Artificial Sequence
  Synthetic Oligonucleotide
uuuuucagcauguauuacuug

SEQ ID NO: 1738 - RNA, 21 nt, Artificial Sequence
  Synthetic Oligonucleotide
uuuucagcauguauuacuuga

SEQ ID NO: 1739 - RNA, 21 nt, Artificial Sequence
  Synthetic Oligonucleotide
uuucagcauguauuacuugac

SEQ ID NO: 1740 - RNA, 21 nt, Artificial Sequence
  Synthetic Oligonucleotide
uucagcauguauuacuugaca

SEQ ID NO: 1741 - RNA, 21 nt, Artificial Sequence
  Synthetic Oligonucleotide
ucagcauguauuacuugacaa

SEQ ID NO: 1742 - RNA, 21 nt, Artificial Sequence
  Synthetic Oligonucleotide
cagcauguauuacuugacaaa

SEQ ID NO: 1743 - RNA, 21 nt, Artificial Sequence
  Synthetic Oligonucleotide
agcauguauuacuugacaaag

SEQ ID NO: 1744 - RNA, 21 nt, Artificial Sequence
  Synthetic Oligonucleotide
uguauuacuugacaaagagac

SEQ ID NO: 1745 - RNA, 21 nt, Artificial Sequence
  Synthetic Oligonucleotide
guauuacuugacaaagagaca

SEQ ID NO: 1746 - RNA, 21 nt, Artificial Sequence
  Synthetic Oligonucleotide
uauuacuugacaaagagacac

SEQ ID NO: 1747 - RNA, 21 nt, Artificial Sequence
  Synthetic Oligonucleotide
auuacuugacaaagagacacu

SEQ ID NO: 1748 - RNA, 21 nt, Artificial Sequence
  Synthetic Oligonucleotide
uuacuugacaaagagacacug

SEQ ID NO: 1749 - RNA, 21 nt, Artificial Sequence
  Synthetic Oligonucleotide
uacuugacaaagagacacugu

SEQ ID NO: 1750 - RNA, 21 nt, Artificial Sequence
  Synthetic Oligonucleotide
acuugacaaagagacacugug

SEQ ID NO: 1751 - RNA, 21 nt, Artificial Sequence
  Synthetic Oligonucleotide
cuugacaaagagacacugugc

SEQ ID NO: 1752 - RNA, 21 nt, Artificial Sequence
  Synthetic Oligonucleotide
uugacaaagagacacugugca

SEQ ID NO: 1753 - RNA, 21 nt, Artificial Sequence
  Synthetic Oligonucleotide
ugacaaagagacacugugcag

SEQ ID NO: 1754 - RNA, 21 nt, Artificial Sequence
  Synthetic Oligonucleotide
gacaaagagacacugugcaga

SEQ ID NO: 1755 - RNA, 21 nt, Artificial Sequence
  Synthetic Oligonucleotide
acaaagagacacugugcagag

SEQ ID NO: 1756 - RNA, 21 nt, Artificial Sequence
  Synthetic Oligonucleotide
caaagagacacugugcagagg

SEQ ID NO: 1757 - RNA, 21 nt, Artificial Sequence
  Synthetic Oligonucleotide
aaagagacacugugcagaggg

SEQ ID NO: 1758 - RNA, 21 nt, Artificial Sequence
  Synthetic Oligonucleotide
aagagacacugugcagagggu

SEQ ID NO: 1759 - RNA, 21 nt, Artificial Sequence
  Synthetic Oligonucleotide
agagacacugugcagagggug

SEQ ID NO: 1760 - RNA, 21 nt, Artificial Sequence
  Synthetic Oligonucleotide
gagacacugugcagaggguga

SEQ ID NO: 1761 - RNA, 21 nt, Artificial Sequence
  Synthetic Oligonucleotide
agacacugugcagagggugac

SEQ ID NO: 1762 - RNA, 21 nt, Artificial Sequence
  Synthetic Oligonucleotide
gacacugugcagagggugacc

SEQ ID NO: 1763 - RNA, 21 nt, Artificial Sequence
  Synthetic Oligonucleotide
acacugugcagagggugacca

SEQ ID NO: 1764 - RNA, 21 nt, Artificial Sequence
  Synthetic Oligonucleotide
cacugugcagagggugaccac

SEQ ID NO: 1765 - RNA, 21 nt, Artificial Sequence
  Synthetic Oligonucleotide
acugugcagagggugaccaca

SEQ ID NO: 1766 - RNA, 21 nt, Artificial Sequence
  Synthetic Oligonucleotide
cugugcagagggugaccacag

SEQ ID NO: 1767 - RNA, 21 nt, Artificial Sequence
  Synthetic Oligonucleotide
cagucuguaauuccccacuuc

SEQ ID NO: 1768 - RNA, 21 nt, Artificial Sequence
  Synthetic Oligonucleotide
agucuguaauuccccacuuca

SEQ ID NO: 1769 - RNA, 21 nt, Artificial Sequence
  Synthetic Oligonucleotide
gucuguaauuccccacuucaa

SEQ ID NO: 1770 - RNA, 21 nt, Artificial Sequence
  Synthetic Oligonucleotide
ucuguaauuccccacuucaau

SEQ ID NO: 1771 - RNA, 21 nt, Artificial Sequence
  Synthetic Oligonucleotide
caauacaaagggugucguucu

SEQ ID NO: 1772 - RNA, 21 nt, Artificial Sequence
  Synthetic Oligonucleotide
aauacaaagggugucguucuu

SEQ ID NO: 1773 - RNA, 21 nt, Artificial Sequence
  Synthetic Oligonucleotide
auacaaagggugucguucuuu

SEQ ID NO: 1774 - RNA, 21 nt, Artificial Sequence
  Synthetic Oligonucleotide
uacaaagggugucguucuuuu

SEQ ID NO: 1775 - RNA, 21 nt, Artificial Sequence
  Synthetic Oligonucleotide
acaaagggugucguucuuuuc

SEQ ID NO: 1776 - RNA, 21 nt, Artificial Sequence
  Synthetic Oligonucleotide
caaagggugucguucuuuucc

SEQ ID NO: 1777 - RNA, 21 nt, Artificial Sequence
  Synthetic Oligonucleotide
aaagggugucguucuuuucca

SEQ ID NO: 1778 - RNA, 21 nt, Artificial Sequence
  Synthetic Oligonucleotide
aagggugucguucuuuuccaa

SEQ ID NO: 1779 - RNA, 21 nt, Artificial Sequence
  Synthetic Oligonucleotide
agggugucguucuuuuccaac

SEQ ID NO: 1780 - RNA, 21 nt, Artificial Sequence
  Synthetic Oligonucleotide
gggugucguucuuuuccaaca

SEQ ID NO: 1781 - RNA, 21 nt, Artificial Sequence
  Synthetic Oligonucleotide
ggugucguucuuuuccaacaa

SEQ ID NO: 1782 - RNA, 21 nt, Artificial Sequence
  Synthetic Oligonucleotide
gugucguucuuuuccaacaaa

SEQ ID NO: 1783 - RNA, 21 nt, Artificial Sequence
  Synthetic Oligonucleotide
ugucguucuuuuccaacaaaa

SEQ ID NO: 1784 - RNA, 21 nt, Artificial Sequence
  Synthetic Oligonucleotide
gucguucuuuuccaacaaaau

SEQ ID NO: 1785 - RNA, 21 nt, Artificial Sequence
  Synthetic Oligonucleotide
ucguucuuuuccaacaaaaua

SEQ ID NO: 1786 - RNA, 21 nt, Artificial Sequence
  Synthetic Oligonucleotide
cguucuuuuccaacaaaauag

SEQ ID NO: 1787 - RNA, 21 nt, Artificial Sequence
  Synthetic Oligonucleotide
guucuuuuccaacaaaauagc

SEQ ID NO: 1788 - RNA, 21 nt, Artificial Sequence
  Synthetic Oligonucleotide
uccaacaaaauagcaaucccu

SEQ ID NO: 1789 - RNA, 21 nt, Artificial Sequence
  Synthetic Oligonucleotide
ccaacaaaauagcaaucccuu

SEQ ID NO: 1790 - RNA, 21 nt, Artificial Sequence
  Synthetic Oligonucleotide
caacaaaauagcaaucccuuu

SEQ ID NO: 1791 - RNA, 21 nt, Artificial Sequence
  Synthetic Oligonucleotide
aacaaaauagcaaucccuuuu

SEQ ID NO: 1792 - RNA, 21 nt, Artificial Sequence
  Synthetic Oligonucleotide
acaaaauagcaaucccuuuua

SEQ ID NO: 1793 - RNA, 21 nt, Artificial Sequence
  Synthetic Oligonucleotide
auuucauugcuuuugacuuuu

SEQ ID NO: 1794 - RNA, 21 nt, Artificial Sequence
  Synthetic Oligonucleotide
uuucauugcuuuugacuuuuc

SEQ ID NO: 1795 - RNA, 21 nt, Artificial Sequence
  Synthetic Oligonucleotide
uucauugcuuuugacuuuuca

SEQ ID NO: 1796 - RNA, 21 nt, Artificial Sequence
  Synthetic Oligonucleotide
ucauugcuuuugacuuuucaa

SEQ ID NO: 1797 - RNA, 21 nt, Artificial Sequence
  Synthetic Oligonucleotide
cauugcuuuugacuuuucaau

SEQ ID NO: 1798 - RNA, 21 nt, Artificial Sequence
  Synthetic Oligonucleotide
auugcuuuugacuuuucaaug

SEQ ID NO: 1799 - RNA, 21 nt, Artificial Sequence
  Synthetic Oligonucleotide
uugcuuuugacuuuucaaugg

SEQ ID NO: 1800 - RNA, 21 nt, Artificial Sequence
  Synthetic Oligonucleotide
ugcuuuugacuuuucaauggg

SEQ ID NO: 1801 - RNA, 21 nt, Artificial Sequence
  Synthetic Oligonucleotide
gcuuuugacuuuucaaugggu

SEQ ID NO: 1802 - RNA, 21 nt, Artificial Sequence
  Synthetic Oligonucleotide
cuuuugacuuuucaaugggug

SEQ ID NO: 1803 - RNA, 21 nt, Artificial Sequence
  Synthetic Oligonucleotide
uuuugacuuuucaaugggugu

SEQ ID NO: 1804 - RNA, 21 nt, Artificial Sequence
  Synthetic Oligonucleotide
uuugacuuuucaauggguguc

SEQ ID NO: 1805 - RNA, 21 nt, Artificial Sequence
  Synthetic Oligonucleotide
uugacuuuucaaugggugucc

SEQ ID NO: 1806 - RNA, 21 nt, Artificial Sequence
  Synthetic Oligonucleotide
ugacuuuucaauggguguccu

SEQ ID NO: 1807 - RNA, 21 nt, Artificial Sequence
  Synthetic Oligonucleotide
gacuuuucaauggguguccua

SEQ ID NO: 1808 - RNA, 21 nt, Artificial Sequence
  Synthetic Oligonucleotide
acuuuucaauggguguccuag

SEQ ID NO: 1809 - RNA, 21 nt, Artificial Sequence
  Synthetic Oligonucleotide
cuuuucaauggguguccuagg

SEQ ID NO: 1810 - RNA, 21 nt, Artificial Sequence
  Synthetic Oligonucleotide
uuuucaauggguguccuagga

SEQ ID NO: 1811 - RNA, 21 nt, Artificial Sequence
  Synthetic Oligonucleotide
uuucaauggguguccuaggaa

SEQ ID NO: 1812 - RNA, 21 nt, Artificial Sequence
  Synthetic Oligonucleotide
uucaauggguguccuaggaac

SEQ ID NO: 1813 - RNA, 21 nt, Artificial Sequence
  Synthetic Oligonucleotide
ucaauggguguccuaggaacc

SEQ ID NO: 1814 - RNA, 21 nt, Artificial Sequence
  Synthetic Oligonucleotide
caauggguguccuaggaaccu

SEQ ID NO: 1815 - RNA, 21 nt, Artificial Sequence
  Synthetic Oligonucleotide
aauggguguccuaggaaccuu

SEQ ID NO: 1816 - RNA, 21 nt, Artificial Sequence
  Synthetic Oligonucleotide
agaaauggacuuucauccugg

SEQ ID NO: 1817 - RNA, 21 nt, Artificial Sequence
  Synthetic Oligonucleotide
gaaauggacuuucauccugga

SEQ ID NO: 1818 - RNA, 21 nt, Artificial Sequence
  Synthetic Oligonucleotide
aaauggacuuucauccuggaa

SEQ ID NO: 1819 - RNA, 21 nt, Artificial Sequence
  Synthetic Oligonucleotide
aauggacuuucauccuggaaa

SEQ ID NO: 1820 - RNA, 21 nt, Artificial Sequence
  Synthetic Oligonucleotide
auggacuuucauccuggaaau

SEQ ID NO: 1821 - RNA, 21 nt, Artificial Sequence
  Synthetic Oligonucleotide
uggacuuucauccuggaaaua

SEQ ID NO: 1822 - RNA, 21 nt, Artificial Sequence
  Synthetic Oligonucleotide
ggacuuucauccuggaaauau

SEQ ID NO: 1823 - RNA, 21 nt, Artificial Sequence
  Synthetic Oligonucleotide
gacuuucauccuggaaauaua

SEQ ID NO: 1824 - RNA, 21 nt, Artificial Sequence
  Synthetic Oligonucleotide
acuuucauccuggaaauauau

SEQ ID NO: 1825 - RNA, 21 nt, Artificial Sequence
  Synthetic Oligonucleotide
cuuucauccuggaaauauauu

SEQ ID NO: 1826 - RNA, 21 nt, Artificial Sequence
  Synthetic Oligonucleotide
uuucauccuggaaauauauua

SEQ ID NO: 1827 - RNA, 21 nt, Artificial Sequence
  Synthetic Oligonucleotide
uucauccuggaaauauauuaa

SEQ ID NO: 1828 - RNA, 21 nt, Artificial Sequence
  Synthetic Oligonucleotide
ucauccuggaaauauauuaac

SEQ ID NO: 1829 - RNA, 21 nt, Artificial Sequence
  Synthetic Oligonucleotide
cauccuggaaauauauuaacu

SEQ ID NO: 1830 - RNA, 21 nt, Artificial Sequence
  Synthetic Oligonucleotide
auccuggaaauauauuaacug

SEQ ID NO: 1831 - RNA, 21 nt, Artificial Sequence
  Synthetic Oligonucleotide
uccuggaaauauauuaacugu

SEQ ID NO: 1832 - RNA, 21 nt, Artificial Sequence
  Synthetic Oligonucleotide
ccuggaaauauauuaacuguu

SEQ ID NO: 1833 - RNA, 21 nt, Artificial Sequence
  Synthetic Oligonucleotide
cuggaaauauauuaacuguua

SEQ ID NO: 1834 - RNA, 21 nt, Artificial Sequence
  Synthetic Oligonucleotide
uggaaauauauuaacuguuaa

SEQ ID NO: 1835 - RNA, 21 nt, Artificial Sequence
  Synthetic Oligonucleotide
ggaaauauauuaacuguuaaa

SEQ ID NO: 1836 - RNA, 21 nt, Artificial Sequence
  Synthetic Oligonucleotide
gaaauauauuaacuguuaaaa

SEQ ID NO: 1837 - RNA, 21 nt, Artificial Sequence
  Synthetic Oligonucleotide
aaauauauuaacuguuaaaaa

SEQ ID NO: 1838 - RNA, 21 nt, Artificial Sequence
  Synthetic Oligonucleotide
aauauauuaacuguuaaaaag

SEQ ID NO: 1839 - RNA, 21 nt, Artificial Sequence
  Synthetic Oligonucleotide
auauauuaacuguuaaaaaga

SEQ ID NO: 1840 - RNA, 21 nt, Artificial Sequence
  Synthetic Oligonucleotide
uauauuaacuguuaaaaagaa

SEQ ID NO: 1841 - RNA, 21 nt, Artificial Sequence
  Synthetic Oligonucleotide
auauuaacuguuaaaaagaaa

SEQ ID NO: 1842 - RNA, 21 nt, Artificial Sequence
  Synthetic Oligonucleotide
uauuaacuguuaaaaagaaaa

SEQ ID NO: 1843 - RNA, 21 nt, Artificial Sequence
  Synthetic Oligonucleotide
auuaacuguuaaaaagaaaac

SEQ ID NO: 1844 - RNA, 21 nt, Artificial Sequence
  Synthetic Oligonucleotide
uuaacuguuaaaaagaaaaca

SEQ ID NO: 1845 - RNA, 21 nt, Artificial Sequence
  Synthetic Oligonucleotide
uaacuguuaaaaagaaaacau

SEQ ID NO: 1846 - RNA, 21 nt, Artificial Sequence
  Synthetic Oligonucleotide
aacuguuaaaaagaaaacauu

SEQ ID NO: 1847 - RNA, 21 nt, Artificial Sequence
  Synthetic Oligonucleotide
acuguuaaaaagaaaacauug

SEQ ID NO: 1848 - RNA, 21 nt, Artificial Sequence
  Synthetic Oligonucleotide
cuguuaaaaagaaaacauuga

SEQ ID NO: 1849 - RNA, 21 nt, Artificial Sequence
  Synthetic Oligonucleotide
uguuaaaaagaaaacauugaa

SEQ ID NO: 1850 - RNA, 21 nt, Artificial Sequence
  Synthetic Oligonucleotide
gacaacgucauccccuggcag

SEQ ID NO: 1851 - RNA, 21 nt, Artificial Sequence
  Synthetic Oligonucleotide
acaacgucauccccuggcagg

SEQ ID NO: 1852 - RNA, 21 nt, Artificial Sequence
  Synthetic Oligonucleotide
caacgucauccccuggcaggc

SEQ ID NO: 1853 - RNA, 21 nt, Artificial Sequence
  Synthetic Oligonucleotide
aacgucauccccuggcaggcu

SEQ ID NO: 1854 - RNA, 21 nt, Artificial Sequence
  Synthetic Oligonucleotide
acgucauccccuggcaggcua

SEQ ID NO: 1855 - RNA, 21 nt, Artificial Sequence
  Synthetic Oligonucleotide
cgucauccccuggcaggcuaa

SEQ ID NO: 1856 - RNA, 21 nt, Artificial Sequence
  Synthetic Oligonucleotide
gucauccccuggcaggcuaaa

SEQ ID NO: 1857 - RNA, 21 nt, Artificial Sequence
  Synthetic Oligonucleotide
ucauccccuggcaggcuaaag

SEQ ID NO: 1858 - RNA, 21 nt, Artificial Sequence
  Synthetic Oligonucleotide
cauccccuggcaggcuaaagu

SEQ ID NO: 1859 - RNA, 21 nt, Artificial Sequence
  Synthetic Oligonucleotide
auccccuggcaggcuaaagug

SEQ ID NO: 1860 - RNA, 21 nt, Artificial Sequence
  Synthetic Oligonucleotide
uccccuggcaggcuaaagugc

SEQ ID NO: 1861 - RNA, 21 nt, Artificial Sequence
  Synthetic Oligonucleotide
ccccuggcaggcuaaagugcu

SEQ ID NO: 1862 - RNA, 21 nt, Artificial Sequence
  Synthetic Oligonucleotide
cccuggcaggcuaaagugcug

SEQ ID NO: 1863 - RNA, 21 nt, Artificial Sequence
  Synthetic Oligonucleotide
agguagcaaacacuaagguga

SEQ ID NO: 1864 - RNA, 21 nt, Artificial Sequence
  Synthetic Oligonucleotide
gguagcaaacacuaaggugaa

SEQ ID NO: 1865 - RNA, 21 nt, Artificial Sequence
  Synthetic Oligonucleotide
guagcaaacacuaaggugaaa

SEQ ID NO: 1866 - RNA, 21 nt, Artificial Sequence
  Synthetic Oligonucleotide
uagcaaacacuaaggugaaaa

SEQ ID NO: 1867 - RNA, 21 nt, Artificial Sequence
  Synthetic Oligonucleotide
gcaaacacuaaggugaaaaga

SEQ ID NO: 1868 - RNA, 21 nt, Artificial Sequence
  Synthetic Oligonucleotide
caaacacuaaggugaaaagau

SEQ ID NO: 1869 - RNA, 21 nt, Artificial Sequence
  Synthetic Oligonucleotide
cacuaaggugaaaagauaaug

SEQ ID NO: 1870 - RNA, 21 nt, Artificial Sequence
  Synthetic Oligonucleotide
acuaaggugaaaagauaauga

SEQ ID NO: 1871 - RNA, 21 nt, Artificial Sequence
  Synthetic Oligonucleotide
cuaaggugaaaagauaaugau

SEQ ID NO: 1872 - RNA, 21 nt, Artificial Sequence
  Synthetic Oligonucleotide
uaaggugaaaagauaaugauc

SEQ ID NO: 1873 - RNA, 21 nt, Artificial Sequence
  Synthetic Oligonucleotide
aaggugaaaagauaaugaucu

SEQ ID NO: 1874 - RNA, 21 nt, Artificial Sequence
  Synthetic Oligonucleotide
aggugaaaagauaaugaucuc

SEQ ID NO: 1875 - RNA, 21 nt, Artificial Sequence
  Synthetic Oligonucleotide
ggugaaaagauaaugaucuca

SEQ ID NO: 1876 - RNA, 21 nt, Artificial Sequence
  Synthetic Oligonucleotide
gugaaaagauaaugaucucau

SEQ ID NO: 1877 - RNA, 21 nt, Artificial Sequence
  Synthetic Oligonucleotide
ugaaaagauaaugaucucauu

SEQ ID NO: 1878 - RNA, 21 nt, Artificial Sequence
  Synthetic Oligonucleotide
gaaaagauaaugaucucauug

SEQ ID NO: 1879 - RNA, 21 nt, Artificial Sequence
  Synthetic Oligonucleotide
aaaagauaaugaucucauugu

SEQ ID NO: 1880 - RNA, 21 nt, Artificial Sequence
  Synthetic Oligonucleotide
aaagauaaugaucucauuguu

SEQ ID NO: 1881 - RNA, 21 nt, Artificial Sequence
  Synthetic Oligonucleotide
aagauaaugaucucauuguuu

SEQ ID NO: 1882 - RNA, 21 nt, Artificial Sequence
  Synthetic Oligonucleotide
agauaaugaucucauuguuua

SEQ ID NO: 1883 - RNA, 21 nt, Artificial Sequence
  Synthetic Oligonucleotide
gauaaugaucucauuguuuau

SEQ ID NO: 1884 - RNA, 21 nt, Artificial Sequence
  Synthetic Oligonucleotide
auaaugaucucauuguuuauu

SEQ ID NO: 1885 - RNA, 21 nt, Artificial Sequence
  Synthetic Oligonucleotide
uaaugaucucauuguuuauua

SEQ ID NO: 1886 - RNA, 21 nt, Artificial Sequence
  Synthetic Oligonucleotide
aaugaucucauuguuuauuaa

SEQ ID NO: 1887 - RNA, 21 nt, Artificial Sequence
  Synthetic Oligonucleotide
augaucucauuguuuauuaac

SEQ ID NO: 1888 - RNA, 21 nt, Artificial Sequence
  Synthetic Oligonucleotide
ugaucucauuguuuauuaacc

SEQ ID NO: 1889 - RNA, 21 nt, Artificial Sequence
  Synthetic Oligonucleotide
gaucucauuguuuauuaaccu

SEQ ID NO: 1890 - RNA, 21 nt, Artificial Sequence
  Synthetic Oligonucleotide
aucucauuguuuauuaaccug

SEQ ID NO: 1891 - RNA, 21 nt, Artificial Sequence
  Synthetic Oligonucleotide
ucucauuguuuauuaaccugu

SEQ ID NO: 1892 - RNA, 21 nt, Artificial Sequence
  Synthetic Oligonucleotide
cucauuguuuauuaaccugua

SEQ ID NO: 1893 - RNA, 21 nt, Artificial Sequence
  Synthetic Oligonucleotide
ucauuguuuauuaaccuguau

SEQ ID NO: 1894 - RNA, 21 nt, Artificial Sequence
  Synthetic Oligonucleotide
uuguuuauuaaccuguauucu

SEQ ID NO: 1895 - RNA, 21 nt, Artificial Sequence
  Synthetic Oligonucleotide
uguuuauuaaccuguauucug

SEQ ID NO: 1896 - RNA, 21 nt, Artificial Sequence
  Synthetic Oligonucleotide
uuauuaaccuguauucuguuu

SEQ ID NO: 1897 - RNA, 21 nt, Artificial Sequence
  Synthetic Oligonucleotide
uauuaaccuguauucuguuua

SEQ ID NO: 1898 - RNA, 21 nt, Artificial Sequence
  Synthetic Oligonucleotide
cuuuaaaacagugguucuuaa

SEQ ID NO: 1899 - RNA, 21 nt, Artificial Sequence
  Synthetic Oligonucleotide
uuuaaaacagugguucuuaaa

SEQ ID NO: 1900 - RNA, 21 nt, Artificial Sequence
  Synthetic Oligonucleotide
uuaaaacagugguucuuaaau

SEQ ID NO: 1901 - RNA, 21 nt, Artificial Sequence
  Synthetic Oligonucleotide
uaaaacagugguucuuaaauu

SEQ ID NO: 1902 - RNA, 21 nt, Artificial Sequence
  Synthetic Oligonucleotide
aaaacagugguucuuaaauug

SEQ ID NO: 1903 - RNA, 21 nt, Artificial Sequence
  Synthetic Oligonucleotide
aaacagugguucuuaaauugu

SEQ ID NO: 1904 - RNA, 21 nt, Artificial Sequence
  Synthetic Oligonucleotide
aacagugguucuuaaauugua

SEQ ID NO: 1905 - RNA, 21 nt, Artificial Sequence
  Synthetic Oligonucleotide
ugguucuuaaauuguaagcuc

SEQ ID NO: 1906 - RNA, 21 nt, Artificial Sequence
  Synthetic Oligonucleotide
uucuuaaauuguaagcucagg

SEQ ID NO: 1907 - RNA, 21 nt, Artificial Sequence
  Synthetic Oligonucleotide
ucuuaaauuguaagcucaggu

SEQ ID NO: 1908 - RNA, 21 nt, Artificial Sequence
  Synthetic Oligonucleotide
uuaaauuguaagcucagguuc

SEQ ID NO: 1909 - RNA, 21 nt, Artificial Sequence
  Synthetic Oligonucleotide
uaaauuguaagcucagguuca

SEQ ID NO: 1910 - RNA, 21 nt, Artificial Sequence
  Synthetic Oligonucleotide
aaauuguaagcucagguucaa

SEQ ID NO: 1911 - RNA, 21 nt, Artificial Sequence
  Synthetic Oligonucleotide
uuggugauacuucuuugaaug

SEQ ID NO: 1912 - RNA, 21 nt, Artificial Sequence
  Synthetic Oligonucleotide
caaucacaucuuuagugucug

SEQ ID NO: 1913 - RNA, 21 nt, Artificial Sequence
  Synthetic Oligonucleotide
uuuagugucugaauauaucca

SEQ ID NO: 1914 - RNA, 21 nt, Artificial Sequence
  Synthetic Oligonucleotide
uuagugucugaauauauccaa

SEQ ID NO: 1915 - RNA, 21 nt, Artificial Sequence
  Synthetic Oligonucleotide
uagugucugaauauauccaaa

SEQ ID NO: 1916 - RNA, 21 nt, Artificial Sequence
  Synthetic Oligonucleotide
gugucugaauauauccaaaug

SEQ ID NO: 1917 - RNA, 21 nt, Artificial Sequence
  Synthetic Oligonucleotide
ugucugaauauauccaaaugu

SEQ ID NO: 1918 - RNA, 21 nt, Artificial Sequence
  Synthetic Oligonucleotide
gucugaauauauccaaauguu

SEQ ID NO: 1919 - RNA, 21 nt, Artificial Sequence
  Synthetic Oligonucleotide
ucugaauauauccaaauguuu

SEQ ID NO: 1920 - RNA, 21 nt, Artificial Sequence
  Synthetic Oligonucleotide
cugaauauauccaaauguuuu

SEQ ID NO: 1921 - RNA, 27 nt, Artificial Sequence
  Synthetic Oligonucleotide
ccggcuaauuuguaucaaugauuauga

SEQ ID NO: 1922 - RNA, 27 nt, Artificial Sequence
  Synthetic Oligonucleotide
cggcuaauuuguaucaaugauuaugaa

SEQ ID NO: 1923 - RNA, 27 nt, Artificial Sequence
  Synthetic Oligonucleotide
ggcuaauuuguaucaaugauuaugaac

SEQ ID NO: 1924 - RNA, 27 nt, Artificial Sequence
  Synthetic Oligonucleotide
gcuaauuuguaucaaugauuaugaaca

SEQ ID NO: 1925 - RNA, 27 nt, Artificial Sequence
  Synthetic Oligonucleotide
cuaauuuguaucaaugauuaugaacaa

SEQ ID NO: 1926 - RNA, 27 nt, Artificial Sequence
  Synthetic Oligonucleotide
uaauuuguaucaaugauuaugaacaac

SEQ ID NO: 1927 - RNA, 27 nt, Artificial Sequence
  Synthetic Oligonucleotide
aauuuguaucaaugauuaugaacaaca

SEQ ID NO: 1928 - RNA, 27 nt, Artificial Sequence
  Synthetic Oligonucleotide
auuuguaucaaugauuaugaacaacau

SEQ ID NO: 1929 - RNA, 27 nt, Artificial Sequence
  Synthetic Oligonucleotide
uuuguaucaaugauuaugaacaacaug

SEQ ID NO: 1930 - RNA, 27 nt, Artificial Sequence
  Synthetic Oligonucleotide
uuguaucaaugauuaugaacaacaugc

SEQ ID NO: 1931 - RNA, 27 nt, Artificial Sequence
  Synthetic Oligonucleotide
guaucaaugauuaugaacaacaugcua

SEQ ID NO: 1932 - RNA, 27 nt, Artificial Sequence
  Synthetic Oligonucleotide
uaucaaugauuaugaacaacaugcuaa

SEQ ID NO: 1933 - RNA, 27 nt, Artificial Sequence
  Synthetic Oligonucleotide
aucaaugauuaugaacaacaugcuaaa

SEQ ID NO: 1934 - RNA, 27 nt, Artificial Sequence
  Synthetic Oligonucleotide
ucaaugauuaugaacaacaugcuaaau

SEQ ID NO: 1935 - RNA, 27 nt, Artificial Sequence
  Synthetic Oligonucleotide
caaugauuaugaacaacaugcuaaauc

SEQ ID NO: 1936 - RNA, 27 nt, Artificial Sequence
  Synthetic Oligonucleotide
aaugauuaugaacaacaugcuaaauca

SEQ ID NO: 1937 - RNA, 27 nt, Artificial Sequence
  Synthetic Oligonucleotide
augauuaugaacaacaugcuaaaucag

SEQ ID NO: 1938 - RNA, 27 nt, Artificial Sequence
  Synthetic Oligonucleotide
ugauuaugaacaacaugcuaaaucagu

SEQ ID NO: 1939 - RNA, 27 nt, Artificial Sequence
  Synthetic Oligonucleotide
uuaugaacaacaugcuaaaucaguacu

SEQ ID NO: 1940 - RNA, 27 nt, Artificial Sequence
  Synthetic Oligonucleotide
augaacaacaugcuaaaucaguacuuc

SEQ ID NO: 1941 - RNA, 27 nt, Artificial Sequence
  Synthetic Oligonucleotide
ugaacaacaugcuaaaucaguacuucc

SEQ ID NO: 1942 - RNA, 27 nt, Artificial Sequence
  Synthetic Oligonucleotide
acaacaugcuaaaucaguacuuccaaa

SEQ ID NO: 1943 - RNA, 27 nt, Artificial Sequence
  Synthetic Oligonucleotide
uaaaucaguacuuccaaagucuauaua

SEQ ID NO: 1944 - RNA, 27 nt, Artificial Sequence
  Synthetic Oligonucleotide
aaaucaguacuuccaaagucuauauau

SEQ ID NO: 1945 - RNA, 27 nt, Artificial Sequence
  Synthetic Oligonucleotide
aucaguacuuccaaagucuauauauga

SEQ ID NO: 1946 - RNA, 27 nt, Artificial Sequence
  Synthetic Oligonucleotide
ucaguacuuccaaagucuauauaugac

SEQ ID NO: 1947 - RNA, 27 nt, Artificial Sequence
  Synthetic Oligonucleotide
caguacuuccaaagucuauauaugacu

SEQ ID NO: 1948 - RNA, 27 nt, Artificial Sequence
  Synthetic Oligonucleotide
uacuuccaaagucuauauaugacuauu

SEQ ID NO: 1949 - RNA, 27 nt, Artificial Sequence
  Synthetic Oligonucleotide
uuccaaagucuauauaugacuauuaca

SEQ ID NO: 1950 - RNA, 27 nt, Artificial Sequence
  Synthetic Oligonucleotide
uccaaagucuauauaugacuauuacag

SEQ ID NO: 1951 - RNA, 27 nt, Artificial Sequence
  Synthetic Oligonucleotide
caaagucuauauaugacuauuacaggu

SEQ ID NO: 1952 - RNA, 27 nt, Artificial Sequence
  Synthetic Oligonucleotide
uauaugacuauuacaggucuggggcaa

SEQ ID NO: 1953 - RNA, 27 nt, Artificial Sequence
  Synthetic Oligonucleotide
auaugacuauuacaggucuggggcaaa

SEQ ID NO: 1954 - RNA, 27 nt, Artificial Sequence
  Synthetic Oligonucleotide
uaugacuauuacaggucuggggcaaau

SEQ ID NO: 1955 - RNA, 27 nt, Artificial Sequence
  Synthetic Oligonucleotide
augacuauuacaggucuggggcaaaug

SEQ ID NO: 1956 - RNA, 27 nt, Artificial Sequence
  Synthetic Oligonucleotide
ugacuauuacaggucuggggcaaauga

SEQ ID NO: 1957 - RNA, 27 nt, Artificial Sequence
  Synthetic Oligonucleotide
gacuauuacaggucuggggcaaaugau

SEQ ID NO: 1958 - RNA, 27 nt, Artificial Sequence
  Synthetic Oligonucleotide
acuauuacaggucuggggcaaaugaug

SEQ ID NO: 1959 - RNA, 27 nt, Artificial Sequence
  Synthetic Oligonucleotide
cuauuacaggucuggggcaaaugauga

SEQ ID NO: 1960 - RNA, 27 nt, Artificial Sequence
  Synthetic Oligonucleotide
uauuacaggucuggggcaaaugaugaa

SEQ ID NO: 1961 - RNA, 27 nt, Artificial Sequence
  Synthetic Oligonucleotide
auuacaggucuggggcaaaugaugaag

SEQ ID NO: 1962 - RNA, 27 nt, Artificial Sequence
  Synthetic Oligonucleotide
uuacaggucuggggcaaaugaugaaga

SEQ ID NO: 1963 - RNA, 27 nt, Artificial Sequence
  Synthetic Oligonucleotide
uacaggucuggggcaaaugaugaagaa

SEQ ID NO: 1964 - RNA, 27 nt, Artificial Sequence
  Synthetic Oligonucleotide
ccggaauguugcugaaacagaucuguc

SEQ ID NO: 1965 - RNA, 27 nt, Artificial Sequence
  Synthetic Oligonucleotide
cgacuucuguuuuaggacagaggguca

SEQ ID NO: 1966 - RNA, 27 nt, Artificial Sequence
  Synthetic Oligonucleotide
gacuucuguuuuaggacagagggucag

SEQ ID NO: 1967 - RNA, 27 nt, Artificial Sequence
  Synthetic Oligonucleotide
gcuacaaggccauauuugugacagugg

SEQ ID NO: 1968 - RNA, 27 nt, Artificial Sequence
  Synthetic Oligonucleotide
cuacaaggccauauuugugacagugga

SEQ ID NO: 1969 - RNA, 27 nt, Artificial Sequence
  Synthetic Oligonucleotide
cgccacaacucaggaugaaaaauuuug

SEQ ID NO: 1970 - RNA, 27 nt, Artificial Sequence
  Synthetic Oligonucleotide
gccacaacucaggaugaaaaauuuuga

SEQ ID NO: 1971 - RNA, 27 nt, Artificial Sequence
  Synthetic Oligonucleotide
ccacaacucaggaugaaaaauuuugaa

SEQ ID NO: 1972 - RNA, 27 nt, Artificial Sequence
  Synthetic Oligonucleotide
cacaacucaggaugaaaaauuuugaaa

SEQ ID NO: 1973 - RNA, 27 nt, Artificial Sequence
  Synthetic Oligonucleotide
acaacucaggaugaaaaauuuugaaac

SEQ ID NO: 1974 - RNA, 27 nt, Artificial Sequence
  Synthetic Oligonucleotide
aacucaggaugaaaaauuuugaaacca

SEQ ID NO: 1975 - RNA, 27 nt, Artificial Sequence
  Synthetic Oligonucleotide
acucaggaugaaaaauuuugaaaccag

SEQ ID NO: 1976 - RNA, 27 nt, Artificial Sequence
  Synthetic Oligonucleotide
cucaggaugaaaaauuuugaaaccagu

SEQ ID NO: 1977 - RNA, 27 nt, Artificial Sequence
  Synthetic Oligonucleotide
ucaggaugaaaaauuuugaaaccagua

SEQ ID NO: 1978 - RNA, 27 nt, Artificial Sequence
  Synthetic Oligonucleotide
aggaugaaaaauuuugaaaccaguacu

SEQ ID NO: 1979 - RNA, 27 nt, Artificial Sequence
  Synthetic Oligonucleotide
ggaugaaaaauuuugaaaccaguacuu

SEQ ID NO: 1980 - RNA, 27 nt, Artificial Sequence
  Synthetic Oligonucleotide
gaugaaaaauuuugaaaccaguacuuu

SEQ ID NO: 1981 - RNA, 27 nt, Artificial Sequence
  Synthetic Oligonucleotide
augaaaaauuuugaaaccaguacuuua

SEQ ID NO: 1982 - RNA, 27 nt, Artificial Sequence
  Synthetic Oligonucleotide
ugaaaaauuuugaaaccaguacuuuau

SEQ ID NO: 1983 - RNA, 27 nt, Artificial Sequence
  Synthetic Oligonucleotide
gaaaaauuuugaaaccaguacuuuauc

SEQ ID NO: 1984 - RNA, 27 nt, Artificial Sequence
  Synthetic Oligonucleotide
aaaaauuuugaaaccaguacuuuauca

SEQ ID NO: 1985 - RNA, 27 nt, Artificial Sequence
  Synthetic Oligonucleotide
aaaauuuugaaaccaguacuuuaucau

SEQ ID NO: 1986 - RNA, 27 nt, Artificial Sequence
  Synthetic Oligonucleotide
aaauuuugaaaccaguacuuuaucauu

SEQ ID NO: 1987 - RNA, 27 nt, Artificial Sequence
  Synthetic Oligonucleotide
aauuuugaaaccaguacuuuaucauuu

SEQ ID NO: 1988 - RNA, 27 nt, Artificial Sequence
  Synthetic Oligonucleotide
auuuugaaaccaguacuuuaucauuuu

SEQ ID NO: 1989 - RNA, 27 nt, Artificial Sequence
  Synthetic Oligonucleotide
uuuugaaaccaguacuuuaucauuuuc

SEQ ID NO: 1990 - RNA, 27 nt, Artificial Sequence
  Synthetic Oligonucleotide
uuugaaaccaguacuuuaucauuuucu

SEQ ID NO: 1991 - RNA, 27 nt, Artificial Sequence
  Synthetic Oligonucleotide
uugaaaccaguacuuuaucauuuucuc

SEQ ID NO: 1992 - RNA, 27 nt, Artificial Sequence
  Synthetic Oligonucleotide
ugaaaccaguacuuuaucauuuucucc

SEQ ID NO: 1993 - RNA, 27 nt, Artificial Sequence
  Synthetic Oligonucleotide
gaaaccaguacuuuaucauuuucuccu

SEQ ID NO: 1994 - RNA, 27 nt, Artificial Sequence
  Synthetic Oligonucleotide
aaccaguacuuuaucauuuucuccuga

SEQ ID NO: 1995 - RNA, 27 nt, Artificial Sequence
  Synthetic Oligonucleotide
accaguacuuuaucauuuucuccugag

SEQ ID NO: 1996 - RNA, 27 nt, Artificial Sequence
  Synthetic Oligonucleotide
uuaucauuuucuccugaggaaaauuuu

SEQ ID NO: 1997 - RNA, 27 nt, Artificial Sequence
  Synthetic Oligonucleotide
caaauggcugagaagacugacaucauu

SEQ ID NO: 1998 - RNA, 27 nt, Artificial Sequence
  Synthetic Oligonucleotide
gcaaagggcauuuugagaggugaugau

SEQ ID NO: 1999 - RNA, 27 nt, Artificial Sequence
  Synthetic Oligonucleotide
caaagggcauuuugagaggugaugaug

SEQ ID NO: 2000 - RNA, 27 nt, Artificial Sequence
  Synthetic Oligonucleotide
aaagggcauuuugagaggugaugaugc

SEQ ID NO: 2001 - RNA, 27 nt, Artificial Sequence
  Synthetic Oligonucleotide
aagggcauuuugagaggugaugaugcc

SEQ ID NO: 2002 - RNA, 27 nt, Artificial Sequence
  Synthetic Oligonucleotide
agggcauuuugagaggugaugaugcca

SEQ ID NO: 2003 - RNA, 27 nt, Artificial Sequence
  Synthetic Oligonucleotide
gggcauuuugagaggugaugaugccag

SEQ ID NO: 2004 - RNA, 27 nt, Artificial Sequence
  Synthetic Oligonucleotide
ggcauuuugagaggugaugaugccagg

SEQ ID NO: 2005 - RNA, 27 nt, Artificial Sequence
  Synthetic Oligonucleotide
gcauuuugagaggugaugaugccaggg

SEQ ID NO: 2006 - RNA, 27 nt, Artificial Sequence
  Synthetic Oligonucleotide
cauuuugagaggugaugaugccaggga

SEQ ID NO: 2007 - RNA, 27 nt, Artificial Sequence
  Synthetic Oligonucleotide
auuuugagaggugaugaugccagggag

SEQ ID NO: 2008 - RNA, 27 nt, Artificial Sequence
  Synthetic Oligonucleotide
uuuugagaggugaugaugccagggagg

SEQ ID NO: 2009 - RNA, 27 nt, Artificial Sequence
  Synthetic Oligonucleotide
gaaugggaucuuggugucgaaucaugg

SEQ ID NO: 2010 - RNA, 27 nt, Artificial Sequence
  Synthetic Oligonucleotide
aaugggaucuuggugucgaaucauggg

SEQ ID NO: 2011 - RNA, 27 nt, Artificial Sequence
  Synthetic Oligonucleotide
augggaucuuggugucgaaucaugggg

SEQ ID NO: 2012 - RNA, 27 nt, Artificial Sequence
  Synthetic Oligonucleotide
ugggaucuuggugucgaaucauggggc

SEQ ID NO: 2013 - RNA, 27 nt, Artificial Sequence
  Synthetic Oligonucleotide
gggaucuuggugucgaaucauggggcu

SEQ ID NO: 2014 - RNA, 27 nt, Artificial Sequence
  Synthetic Oligonucleotide
ggaucuuggugucgaaucauggggcuc

SEQ ID NO: 2015 - RNA, 27 nt, Artificial Sequence
  Synthetic Oligonucleotide
gaucuuggugucgaaucauggggcucg

SEQ ID NO: 2016 - RNA, 27 nt, Artificial Sequence
  Synthetic Oligonucleotide
aucuuggugucgaaucauggggcucga

SEQ ID NO: 2017 - RNA, 27 nt, Artificial Sequence
  Synthetic Oligonucleotide
ucuuggugucgaaucauggggcucgac

SEQ ID NO: 2018 - RNA, 27 nt, Artificial Sequence
  Synthetic Oligonucleotide
cuuggugucgaaucauggggcucgaca

SEQ ID NO: 2019 - RNA, 27 nt, Artificial Sequence
  Synthetic Oligonucleotide
agccacuauugauguucugccagaaau

SEQ ID NO: 2020 - RNA, 27 nt, Artificial Sequence
  Synthetic Oligonucleotide
cacuauugauguucugccagaaauugu

SEQ ID NO: 2021 - RNA, 27 nt, Artificial Sequence
  Synthetic Oligonucleotide
acuauugauguucugccagaaauugug

SEQ ID NO: 2022 - RNA, 27 nt, Artificial Sequence
  Synthetic Oligonucleotide
uggaggcuguggaagggaagguggaag

SEQ ID NO: 2023 - RNA, 27 nt, Artificial Sequence
  Synthetic Oligonucleotide
ggaggcuguggaagggaagguggaagu

SEQ ID NO: 2024 - RNA, 27 nt, Artificial Sequence
  Synthetic Oligonucleotide
ggggagaaagguguucaagauguccuc

SEQ ID NO: 2025 - RNA, 27 nt, Artificial Sequence
  Synthetic Oligonucleotide
gggagaaagguguucaagauguccucg

SEQ ID NO: 2026 - RNA, 27 nt, Artificial Sequence
  Synthetic Oligonucleotide
ggagaaagguguucaagauguccucga

SEQ ID NO: 2027 - RNA, 27 nt, Artificial Sequence
  Synthetic Oligonucleotide
gagaaagguguucaagauguccucgag

SEQ ID NO: 2028 - RNA, 27 nt, Artificial Sequence
  Synthetic Oligonucleotide
agaaagguguucaagauguccucgaga

SEQ ID NO: 2029 - RNA, 27 nt, Artificial Sequence
  Synthetic Oligonucleotide
gaaagguguucaagauguccucgagau

SEQ ID NO: 2030 - RNA, 27 nt, Artificial Sequence
  Synthetic Oligonucleotide
aaagguguucaagauguccucgagaua

SEQ ID NO: 2031 - RNA, 27 nt, Artificial Sequence
  Synthetic Oligonucleotide
aagguguucaagauguccucgagauac

SEQ ID NO: 2032 - RNA, 27 nt, Artificial Sequence
  Synthetic Oligonucleotide
agguguucaagauguccucgagauacu

SEQ ID NO: 2033 - RNA, 27 nt, Artificial Sequence
  Synthetic Oligonucleotide
gguguucaagauguccucgagauacua

SEQ ID NO: 2034 - RNA, 27 nt, Artificial Sequence
  Synthetic Oligonucleotide
guguucaagauguccucgagauacuaa

SEQ ID NO: 2035 - RNA, 27 nt, Artificial Sequence
  Synthetic Oligonucleotide
uguucaagauguccucgagauacuaaa

SEQ ID NO: 2036 - RNA, 27 nt, Artificial Sequence
  Synthetic Oligonucleotide
guucaagauguccucgagauacuaaag

SEQ ID NO: 2037 - RNA, 27 nt, Artificial Sequence
  Synthetic Oligonucleotide
guuggccauggcucugagugggugcca

SEQ ID NO: 2038 - RNA, 27 nt, Artificial Sequence
  Synthetic Oligonucleotide
uuggccauggcucugagugggugccag

SEQ ID NO: 2039 - RNA, 27 nt, Artificial Sequence
  Synthetic Oligonucleotide
uggccauggcucugagugggugccaga

SEQ ID NO: 2040 - RNA, 27 nt, Artificial Sequence
  Synthetic Oligonucleotide
ggccauggcucugagugggugccagaa

SEQ ID NO: 2041 - RNA, 27 nt, Artificial Sequence
  Synthetic Oligonucleotide
gccauggcucugagugggugccagaau

SEQ ID NO: 2042 - RNA, 27 nt, Artificial Sequence
  Synthetic Oligonucleotide
ccauggcucugagugggugccagaaug

SEQ ID NO: 2043 - RNA, 27 nt, Artificial Sequence
  Synthetic Oligonucleotide
cauggcucugagugggugccagaaugu

SEQ ID NO: 2044 - RNA, 27 nt, Artificial Sequence
  Synthetic Oligonucleotide
auggcucugagugggugccagaaugug

SEQ ID NO: 2045 - RNA, 27 nt, Artificial Sequence
  Synthetic Oligonucleotide
uggcucugagugggugccagaauguga

SEQ ID NO: 2046 - RNA, 27 nt, Artificial Sequence
  Synthetic Oligonucleotide
ggcucugagugggugccagaaugugaa

SEQ ID NO: 2047 - RNA, 27 nt, Artificial Sequence
  Synthetic Oligonucleotide
gcucugagugggugccagaaugugaaa

SEQ ID NO: 2048 - RNA, 27 nt, Artificial Sequence
  Synthetic Oligonucleotide
cucugagugggugccagaaugugaaag

SEQ ID NO: 2049 - RNA, 27 nt, Artificial Sequence
  Synthetic Oligonucleotide
ucugagugggugccagaaugugaaagu

SEQ ID NO: 2050 - RNA, 27 nt, Artificial Sequence
  Synthetic Oligonucleotide
cugagugggugccagaaugugaaaguc

SEQ ID NO: 2051 - RNA, 27 nt, Artificial Sequence
  Synthetic Oligonucleotide
ugagugggugccagaaugugaaaguca

SEQ ID NO: 2052 - RNA, 27 nt, Artificial Sequence
  Synthetic Oligonucleotide
gagugggugccagaaugugaaagucau

SEQ ID NO: 2053 - RNA, 27 nt, Artificial Sequence
  Synthetic Oligonucleotide
agugggugccagaaugugaaagucauc

SEQ ID NO: 2054 - RNA, 27 nt, Artificial Sequence
  Synthetic Oligonucleotide
gugggugccagaaugugaaagucaucg

SEQ ID NO: 2055 - RNA, 27 nt, Artificial Sequence
  Synthetic Oligonucleotide
ugggugccagaaugugaaagucaucga

SEQ ID NO: 2056 - RNA, 27 nt, Artificial Sequence
  Synthetic Oligonucleotide
gggugccagaaugugaaagucaucgac

SEQ ID NO: 2057 - RNA, 27 nt, Artificial Sequence
  Synthetic Oligonucleotide
ggugccagaaugugaaagucaucgaca

SEQ ID NO: 2058 - RNA, 27 nt, Artificial Sequence
  Synthetic Oligonucleotide
gugccagaaugugaaagucaucgacaa

SEQ ID NO: 2059 - RNA, 27 nt, Artificial Sequence
  Synthetic Oligonucleotide
ugccagaaugugaaagucaucgacaag

SEQ ID NO: 2060 - RNA, 27 nt, Artificial Sequence
  Synthetic Oligonucleotide
gccagaaugugaaagucaucgacaaga

SEQ ID NO: 2061 - RNA, 27 nt, Artificial Sequence
  Synthetic Oligonucleotide
ccagaaugugaaagucaucgacaagac

SEQ ID NO: 2062 - RNA, 27 nt, Artificial Sequence
  Synthetic Oligonucleotide
cagaaugugaaagucaucgacaagaca

SEQ ID NO: 2063 - RNA, 27 nt, Artificial Sequence
  Synthetic Oligonucleotide
agaaugugaaagucaucgacaagacau

SEQ ID NO: 2064 - RNA, 27 nt, Artificial Sequence
  Synthetic Oligonucleotide
gaaugugaaagucaucgacaagacauu

SEQ ID NO: 2065 - RNA, 27 nt, Artificial Sequence
  Synthetic Oligonucleotide
aaugugaaagucaucgacaagacauug

SEQ ID NO: 2066 - RNA, 27 nt, Artificial Sequence
  Synthetic Oligonucleotide
augugaaagucaucgacaagacauugg

SEQ ID NO: 2067 - RNA, 27 nt, Artificial Sequence
  Synthetic Oligonucleotide
ugugaaagucaucgacaagacauuggu

SEQ ID NO: 2068 - RNA, 27 nt, Artificial Sequence
  Synthetic Oligonucleotide
gugaaagucaucgacaagacauuggug

SEQ ID NO: 2069 - RNA, 27 nt, Artificial Sequence
  Synthetic Oligonucleotide
ugaaagucaucgacaagacauugguga

SEQ ID NO: 2070 - RNA, 27 nt, Artificial Sequence
  Synthetic Oligonucleotide
gaaagucaucgacaagacauuggugag

SEQ ID NO: 2071 - RNA, 27 nt, Artificial Sequence
  Synthetic Oligonucleotide
aaagucaucgacaagacauuggugagg

SEQ ID NO: 2072 - RNA, 27 nt, Artificial Sequence
  Synthetic Oligonucleotide
aagucaucgacaagacauuggugagga

SEQ ID NO: 2073 - RNA, 27 nt, Artificial Sequence
  Synthetic Oligonucleotide
agucaucgacaagacauuggugaggaa

SEQ ID NO: 2074 - RNA, 27 nt, Artificial Sequence
  Synthetic Oligonucleotide
gucaucgacaagacauuggugaggaaa

SEQ ID NO: 2075 - RNA, 27 nt, Artificial Sequence
  Synthetic Oligonucleotide
ucaucgacaagacauuggugaggaaaa

SEQ ID NO: 2076 - RNA, 27 nt, Artificial Sequence
  Synthetic Oligonucleotide
caucgacaagacauuggugaggaaaaa

SEQ ID NO: 2077 - RNA, 27 nt, Artificial Sequence
  Synthetic Oligonucleotide
aucgacaagacauuggugaggaaaaau

SEQ ID NO: 2078 - RNA, 27 nt, Artificial Sequence
  Synthetic Oligonucleotide
ucgacaagacauuggugaggaaaaauc

SEQ ID NO: 2079 - RNA, 27 nt, Artificial Sequence
  Synthetic Oligonucleotide
cgacaagacauuggugaggaaaaaucc

SEQ ID NO: 2080 - RNA, 27 nt, Artificial Sequence
  Synthetic Oligonucleotide
gacaagacauuggugaggaaaaauccu

SEQ ID NO: 2081 - RNA, 27 nt, Artificial Sequence
  Synthetic Oligonucleotide
acaagacauuggugaggaaaaauccuu

SEQ ID NO: 2082 - RNA, 27 nt, Artificial Sequence
  Synthetic Oligonucleotide
caagacauuggugaggaaaaauccuuu

SEQ ID NO: 2083 - RNA, 27 nt, Artificial Sequence
  Synthetic Oligonucleotide
aagacauuggugaggaaaaauccuuug

SEQ ID NO: 2084 - RNA, 27 nt, Artificial Sequence
  Synthetic Oligonucleotide
agacauuggugaggaaaaauccuuugg

SEQ ID NO: 2085 - RNA, 27 nt, Artificial Sequence
  Synthetic Oligonucleotide
gacauuggugaggaaaaauccuuuggc

SEQ ID NO: 2086 - RNA, 27 nt, Artificial Sequence
  Synthetic Oligonucleotide
acauuggugaggaaaaauccuuuggcc

SEQ ID NO: 2087 - RNA, 27 nt, Artificial Sequence
  Synthetic Oligonucleotide
cauuggugaggaaaaauccuuuggccg

SEQ ID NO: 2088 - RNA, 27 nt, Artificial Sequence
  Synthetic Oligonucleotide
auuggugaggaaaaauccuuuggccgu

SEQ ID NO: 2089 - RNA, 27 nt, Artificial Sequence
  Synthetic Oligonucleotide
uuggugaggaaaaauccuuuggccguu

SEQ ID NO: 2090 - RNA, 27 nt, Artificial Sequence
  Synthetic Oligonucleotide
uggugaggaaaaauccuuuggccguuu

SEQ ID NO: 2091 - RNA, 27 nt, Artificial Sequence
  Synthetic Oligonucleotide
ggugaggaaaaauccuuuggccguuuc

SEQ ID NO: 2092 - RNA, 27 nt, Artificial Sequence
  Synthetic Oligonucleotide
ccguuuccaagaucugacagugcacaa

SEQ ID NO: 2093 - RNA, 27 nt, Artificial Sequence
  Synthetic Oligonucleotide
cguuuccaagaucugacagugcacaau

SEQ ID NO: 2094 - RNA, 27 nt, Artificial Sequence
  Synthetic Oligonucleotide
guuuccaagaucugacagugcacaaua

SEQ ID NO: 2095 - RNA, 27 nt, Artificial Sequence
  Synthetic Oligonucleotide
uuuccaagaucugacagugcacaauau

SEQ ID NO: 2096 - RNA, 27 nt, Artificial Sequence
  Synthetic Oligonucleotide
uuccaagaucugacagugcacaauauu

SEQ ID NO: 2097 - RNA, 27 nt, Artificial Sequence
  Synthetic Oligonucleotide
uccaagaucugacagugcacaauauuu

SEQ ID NO: 2098 - RNA, 27 nt, Artificial Sequence
  Synthetic Oligonucleotide
ccaagaucugacagugcacaauauuuu

SEQ ID NO: 2099 - RNA, 27 nt, Artificial Sequence
  Synthetic Oligonucleotide
caagaucugacagugcacaauauuuuc

SEQ ID NO: 2100 - RNA, 27 nt, Artificial Sequence
  Synthetic Oligonucleotide
aagaucugacagugcacaauauuuucc

SEQ ID NO: 2101 - RNA, 27 nt, Artificial Sequence
  Synthetic Oligonucleotide
agaucugacagugcacaauauuuuccc

SEQ ID NO: 2102 - RNA, 27 nt, Artificial Sequence
  Synthetic Oligonucleotide
gaucugacagugcacaauauuuuccca

SEQ ID NO: 2103 - RNA, 27 nt, Artificial Sequence
  Synthetic Oligonucleotide
aucugacagugcacaauauuuucccau

SEQ ID NO: 2104 - RNA, 27 nt, Artificial Sequence
  Synthetic Oligonucleotide
ucugacagugcacaauauuuucccauc

SEQ ID NO: 2105 - RNA, 27 nt, Artificial Sequence
  Synthetic Oligonucleotide
cugacagugcacaauauuuucccaucu

SEQ ID NO: 2106 - RNA, 27 nt, Artificial Sequence
  Synthetic Oligonucleotide
ugacagugcacaauauuuucccaucug

SEQ ID NO: 2107 - RNA, 27 nt, Artificial Sequence
  Synthetic Oligonucleotide
gacagugcacaauauuuucccaucugu

SEQ ID NO: 2108 - RNA, 27 nt, Artificial Sequence
  Synthetic Oligonucleotide
acagugcacaauauuuucccaucugua

SEQ ID NO: 2109 - RNA, 27 nt, Artificial Sequence
  Synthetic Oligonucleotide
cagugcacaauauuuucccaucuguau

SEQ ID NO: 2110 - RNA, 27 nt, Artificial Sequence
  Synthetic Oligonucleotide
agugcacaauauuuucccaucuguauu

SEQ ID NO: 2111 - RNA, 27 nt, Artificial Sequence
  Synthetic Oligonucleotide
gugcacaauauuuucccaucuguauua

SEQ ID NO: 2112 - RNA, 27 nt, Artificial Sequence
  Synthetic Oligonucleotide
ugcacaauauuuucccaucuguauuau

SEQ ID NO: 2113 - RNA, 27 nt, Artificial Sequence
  Synthetic Oligonucleotide
gcacaauauuuucccaucuguauuauu

SEQ ID NO: 2114 - RNA, 27 nt, Artificial Sequence
  Synthetic Oligonucleotide
cacaauauuuucccaucuguauuauuu

SEQ ID NO: 2115 - RNA, 27 nt, Artificial Sequence
  Synthetic Oligonucleotide
acaauauuuucccaucuguauuauuuu

SEQ ID NO: 2116 - RNA, 27 nt, Artificial Sequence
  Synthetic Oligonucleotide
caauauuuucccaucuguauuauuuuu

SEQ ID NO: 2117 - RNA, 27 nt, Artificial Sequence
  Synthetic Oligonucleotide
aauauuuucccaucuguauuauuuuuu

SEQ ID NO: 2118 - RNA, 27 nt, Artificial Sequence
  Synthetic Oligonucleotide
auauuuucccaucuguauuauuuuuuu

SEQ ID NO: 2119 - RNA, 27 nt, Artificial Sequence
  Synthetic Oligonucleotide
uuuuuuucagcauguauuacuugacaa

SEQ ID NO: 2120 - RNA, 27 nt, Artificial Sequence
  Synthetic Oligonucleotide
uuuuuucagcauguauuacuugacaaa

SEQ ID NO: 2121 - RNA, 27 nt, Artificial Sequence
  Synthetic Oligonucleotide
uuuuucagcauguauuacuugacaaag

SEQ ID NO: 2122 - RNA, 27 nt, Artificial Sequence
  Synthetic Oligonucleotide
uuuucagcauguauuacuugacaaaga

SEQ ID NO: 2123 - RNA, 27 nt, Artificial Sequence
  Synthetic Oligonucleotide
uuucagcauguauuacuugacaaagag

SEQ ID NO: 2124 - RNA, 27 nt, Artificial Sequence
  Synthetic Oligonucleotide
uucagcauguauuacuugacaaagaga

SEQ ID NO: 2125 - RNA, 27 nt, Artificial Sequence
  Synthetic Oligonucleotide
ucagcauguauuacuugacaaagagac

SEQ ID NO: 2126 - RNA, 27 nt, Artificial Sequence
  Synthetic Oligonucleotide
cagcauguauuacuugacaaagagaca

SEQ ID NO: 2127 - RNA, 27 nt, Artificial Sequence
  Synthetic Oligonucleotide
agcauguauuacuugacaaagagacac

SEQ ID NO: 2128 - RNA, 27 nt, Artificial Sequence
  Synthetic Oligonucleotide
uguauuacuugacaaagagacacugug

SEQ ID NO: 2129 - RNA, 27 nt, Artificial Sequence
  Synthetic Oligonucleotide
guauuacuugacaaagagacacugugc

SEQ ID NO: 2130 - RNA, 27 nt, Artificial Sequence
  Synthetic Oligonucleotide
uauuacuugacaaagagacacugugca

SEQ ID NO: 2131 - RNA, 27 nt, Artificial Sequence
  Synthetic Oligonucleotide
auuacuugacaaagagacacugugcag

SEQ ID NO: 2132 - RNA, 27 nt, Artificial Sequence
  Synthetic Oligonucleotide
uuacuugacaaagagacacugugcaga

SEQ ID NO: 2133 - RNA, 27 nt, Artificial Sequence
  Synthetic Oligonucleotide
uacuugacaaagagacacugugcagag

SEQ ID NO: 2134 - RNA, 27 nt, Artificial Sequence
  Synthetic Oligonucleotide
acuugacaaagagacacugugcagagg

SEQ ID NO: 2135 - RNA, 27 nt, Artificial Sequence
  Synthetic Oligonucleotide
cuugacaaagagacacugugcagaggg

SEQ ID NO: 2136 - RNA, 27 nt, Artificial Sequence
  Synthetic Oligonucleotide
uugacaaagagacacugugcagagggu

SEQ ID NO: 2137 - RNA, 27 nt, Artificial Sequence
  Synthetic Oligonucleotide
ugacaaagagacacugugcagagggug

SEQ ID NO: 2138 - RNA, 27 nt, Artificial Sequence
  Synthetic Oligonucleotide
gacaaagagacacugugcagaggguga

SEQ ID NO: 2139 - RNA, 27 nt, Artificial Sequence
  Synthetic Oligonucleotide
acaaagagacacugugcagagggugac

SEQ ID NO: 2140 - RNA, 27 nt, Artificial Sequence
  Synthetic Oligonucleotide
caaagagacacugugcagagggugacc

SEQ ID NO: 2141 - RNA, 27 nt, Artificial Sequence
  Synthetic Oligonucleotide
aaagagacacugugcagagggugacca

SEQ ID NO: 2142 - RNA, 27 nt, Artificial Sequence
  Synthetic Oligonucleotide
aagagacacugugcagagggugaccac

SEQ ID NO: 2143 - RNA, 27 nt, Artificial Sequence
  Synthetic Oligonucleotide
agagacacugugcagagggugaccaca

SEQ ID NO: 2144 - RNA, 27 nt, Artificial Sequence
  Synthetic Oligonucleotide
gagacacugugcagagggugaccacag

SEQ ID NO: 2145 - RNA, 27 nt, Artificial Sequence
  Synthetic Oligonucleotide
agacacugugcagagggugaccacagu

SEQ ID NO: 2146 - RNA, 27 nt, Artificial Sequence
  Synthetic Oligonucleotide
gacacugugcagagggugaccacaguc

SEQ ID NO: 2147 - RNA, 27 nt, Artificial Sequence
  Synthetic Oligonucleotide
acacugugcagagggugaccacagucu

SEQ ID NO: 2148 - RNA, 27 nt, Artificial Sequence
  Synthetic Oligonucleotide
cacugugcagagggugaccacagucug

SEQ ID NO: 2149 - RNA, 27 nt, Artificial Sequence
  Synthetic Oligonucleotide
acugugcagagggugaccacagucugu

SEQ ID NO: 2150 - RNA, 27 nt, Artificial Sequence
  Synthetic Oligonucleotide
cugugcagagggugaccacagucugua

SEQ ID NO: 2151 - RNA, 27 nt, Artificial Sequence
  Synthetic Oligonucleotide
cagucuguaauuccccacuucaauaca

SEQ ID NO: 2152 - RNA, 27 nt, Artificial Sequence
  Synthetic Oligonucleotide
agucuguaauuccccacuucaauacaa

SEQ ID NO: 2153 - RNA, 27 nt, Artificial Sequence
  Synthetic Oligonucleotide
gucuguaauuccccacuucaauacaaa

SEQ ID NO: 2154 - RNA, 27 nt, Artificial Sequence
  Synthetic Oligonucleotide
ucuguaauuccccacuucaauacaaag

SEQ ID NO: 2155 - RNA, 27 nt, Artificial Sequence
  Synthetic Oligonucleotide
caauacaaagggugucguucuuuucca

SEQ ID NO: 2156 - RNA, 27 nt, Artificial Sequence
  Synthetic Oligonucleotide
aauacaaagggugucguucuuuuccaa

SEQ ID NO: 2157 - RNA, 27 nt, Artificial Sequence
  Synthetic Oligonucleotide
auacaaagggugucguucuuuuccaac

SEQ ID NO: 2158 - RNA, 27 nt, Artificial Sequence
  Synthetic Oligonucleotide
uacaaagggugucguucuuuuccaaca

SEQ ID NO: 2159 - RNA, 27 nt, Artificial Sequence
  Synthetic Oligonucleotide
acaaagggugucguucuuuuccaacaa

SEQ ID NO: 2160 - RNA, 27 nt, Artificial Sequence
  Synthetic Oligonucleotide
caaagggugucguucuuuuccaacaaa

SEQ ID NO: 2161 - RNA, 27 nt, Artificial Sequence
  Synthetic Oligonucleotide
aaagggugucguucuuuuccaacaaaa

SEQ ID NO: 2162 - RNA, 27 nt, Artificial Sequence
  Synthetic Oligonucleotide
aagggugucguucuuuuccaacaaaau

SEQ ID NO: 2163 - RNA, 27 nt, Artificial Sequence
  Synthetic Oligonucleotide
agggugucguucuuuuccaacaaaaua

SEQ ID NO: 2164 - RNA, 27 nt, Artificial Sequence
  Synthetic Oligonucleotide
gggugucguucuuuuccaacaaaauag

SEQ ID NO: 2165 - RNA, 27 nt, Artificial Sequence
  Synthetic Oligonucleotide
ggugucguucuuuuccaacaaaauagc

SEQ ID NO: 2166 - RNA, 27 nt, Artificial Sequence
  Synthetic Oligonucleotide
gugucguucuuuuccaacaaaauagca

SEQ ID NO: 2167 - RNA, 27 nt, Artificial Sequence
  Synthetic Oligonucleotide
ugucguucuuuuccaacaaaauagcaa

SEQ ID NO: 2168 - RNA, 27 nt, Artificial Sequence
  Synthetic Oligonucleotide
gucguucuuuuccaacaaaauagcaau

SEQ ID NO: 2169 - RNA, 27 nt, Artificial Sequence
  Synthetic Oligonucleotide
ucguucuuuuccaacaaaauagcaauc

SEQ ID NO: 2170 - RNA, 27 nt, Artificial Sequence
  Synthetic Oligonucleotide
cguucuuuuccaacaaaauagcaaucc

SEQ ID NO: 2171 - RNA, 27 nt, Artificial Sequence
  Synthetic Oligonucleotide
guucuuuuccaacaaaauagcaauccc

SEQ ID NO: 2172 - RNA, 27 nt, Artificial Sequence
  Synthetic Oligonucleotide
uccaacaaaauagcaaucccuuuuauu

SEQ ID NO: 2173 - RNA, 27 nt, Artificial Sequence
  Synthetic Oligonucleotide
ccaacaaaauagcaaucccuuuuauuu

SEQ ID NO: 2174 - RNA, 27 nt, Artificial Sequence
  Synthetic Oligonucleotide
caacaaaauagcaaucccuuuuauuuc

SEQ ID NO: 2175 - RNA, 27 nt, Artificial Sequence
  Synthetic Oligonucleotide
aacaaaauagcaaucccuuuuauuuca

SEQ ID NO: 2176 - RNA, 27 nt, Artificial Sequence
  Synthetic Oligonucleotide
acaaaauagcaaucccuuuuauuucau

SEQ ID NO: 2177 - RNA, 27 nt, Artificial Sequence
  Synthetic Oligonucleotide
auuucauugcuuuugacuuuucaaugg

SEQ ID NO: 2178 - RNA, 27 nt, Artificial Sequence
  Synthetic Oligonucleotide
uuucauugcuuuugacuuuucaauggg

SEQ ID NO: 2179 - RNA, 27 nt, Artificial Sequence
  Synthetic Oligonucleotide
uucauugcuuuugacuuuucaaugggu

SEQ ID NO: 2180 - RNA, 27 nt, Artificial Sequence
  Synthetic Oligonucleotide
ucauugcuuuugacuuuucaaugggug

SEQ ID NO: 2181 - RNA, 27 nt, Artificial Sequence
  Synthetic Oligonucleotide
cauugcuuuugacuuuucaaugggugu

SEQ ID NO: 2182 - RNA, 27 nt, Artificial Sequence
  Synthetic Oligonucleotide
auugcuuuugacuuuucaauggguguc

SEQ ID NO: 2183 - RNA, 27 nt, Artificial Sequence
  Synthetic Oligonucleotide
uugcuuuugacuuuucaaugggugucc

SEQ ID NO: 2184 - RNA, 27 nt, Artificial Sequence
  Synthetic Oligonucleotide
ugcuuuugacuuuucaauggguguccu

SEQ ID NO: 2185 - RNA, 27 nt, Artificial Sequence
  Synthetic Oligonucleotide
gcuuuugacuuuucaauggguguccua

SEQ ID NO: 2186 - RNA, 27 nt, Artificial Sequence
  Synthetic Oligonucleotide
cuuuugacuuuucaauggguguccuag

SEQ ID NO: 2187 - RNA, 27 nt, Artificial Sequence
  Synthetic Oligonucleotide
uuuugacuuuucaauggguguccuagg

SEQ ID NO: 2188 - RNA, 27 nt, Artificial Sequence
  Synthetic Oligonucleotide
uuugacuuuucaauggguguccuagga

SEQ ID NO: 2189 - RNA, 27 nt, Artificial Sequence
  Synthetic Oligonucleotide
uugacuuuucaauggguguccuaggaa

SEQ ID NO: 2190 - RNA, 27 nt, Artificial Sequence
  Synthetic Oligonucleotide
ugacuuuucaauggguguccuaggaac

SEQ ID NO: 2191 - RNA, 27 nt, Artificial Sequence
  Synthetic Oligonucleotide
gacuuuucaauggguguccuaggaacc

SEQ ID NO: 2192 - RNA, 27 nt, Artificial Sequence
  Synthetic Oligonucleotide
acuuuucaauggguguccuaggaaccu

SEQ ID NO: 2193 - RNA, 27 nt, Artificial Sequence
  Synthetic Oligonucleotide
cuuuucaauggguguccuaggaaccuu

SEQ ID NO: 2194 - RNA, 27 nt, Artificial Sequence
  Synthetic Oligonucleotide
uuuucaauggguguccuaggaaccuuu

SEQ ID NO: 2195 - RNA, 27 nt, Artificial Sequence
  Synthetic Oligonucleotide
uuucaauggguguccuaggaaccuuuu

SEQ ID NO: 2196 - RNA, 27 nt, Artificial Sequence
  Synthetic Oligonucleotide
uucaauggguguccuaggaaccuuuua

SEQ ID NO: 2197 - RNA, 27 nt, Artificial Sequence
  Synthetic Oligonucleotide
ucaauggguguccuaggaaccuuuuag

SEQ ID NO: 2198 - RNA, 27 nt, Artificial Sequence
  Synthetic Oligonucleotide
caauggguguccuaggaaccuuuuaga

SEQ ID NO: 2199 - RNA, 27 nt, Artificial Sequence
  Synthetic Oligonucleotide
aauggguguccuaggaaccuuuuagaa

SEQ ID NO: 2200 - RNA, 27 nt, Artificial Sequence
  Synthetic Oligonucleotide
agaaauggacuuucauccuggaaauau

SEQ ID NO: 2201 - RNA, 27 nt, Artificial Sequence
  Synthetic Oligonucleotide
gaaauggacuuucauccuggaaauaua

SEQ ID NO: 2202 - RNA, 27 nt, Artificial Sequence
  Synthetic Oligonucleotide
aaauggacuuucauccuggaaauauau

SEQ ID NO: 2203 - RNA, 27 nt, Artificial Sequence
  Synthetic Oligonucleotide
aauggacuuucauccuggaaauauauu

SEQ ID NO: 2204 - RNA, 27 nt, Artificial Sequence
  Synthetic Oligonucleotide
auggacuuucauccuggaaauauauua

SEQ ID NO: 2205 - RNA, 27 nt, Artificial Sequence
  Synthetic Oligonucleotide
uggacuuucauccuggaaauauauuaa

SEQ ID NO: 2206 - RNA, 27 nt, Artificial Sequence
  Synthetic Oligonucleotide
ggacuuucauccuggaaauauauuaac

SEQ ID NO: 2207 - RNA, 27 nt, Artificial Sequence
  Synthetic Oligonucleotide
gacuuucauccuggaaauauauuaacu

SEQ ID NO: 2208 - RNA, 27 nt, Artificial Sequence
  Synthetic Oligonucleotide
acuuucauccuggaaauauauuaacug

SEQ ID NO: 2209 - RNA, 27 nt, Artificial Sequence
  Synthetic Oligonucleotide
cuuucauccuggaaauauauuaacugu

SEQ ID NO: 2210 - RNA, 27 nt, Artificial Sequence
  Synthetic Oligonucleotide
uuucauccuggaaauauauuaacuguu

SEQ ID NO: 2211 - RNA, 27 nt, Artificial Sequence
  Synthetic Oligonucleotide
uucauccuggaaauauauuaacuguua

SEQ ID NO: 2212 - RNA, 27 nt, Artificial Sequence
  Synthetic Oligonucleotide
ucauccuggaaauauauuaacuguuaa

SEQ ID NO: 2213 - RNA, 27 nt, Artificial Sequence
  Synthetic Oligonucleotide
cauccuggaaauauauuaacuguuaaa

SEQ ID NO: 2214 - RNA, 27 nt, Artificial Sequence
  Synthetic Oligonucleotide
auccuggaaauauauuaacuguuaaaa

SEQ ID NO: 2215 - RNA, 27 nt, Artificial Sequence
  Synthetic Oligonucleotide
uccuggaaauauauuaacuguuaaaaa

SEQ ID NO: 2216 - RNA, 27 nt, Artificial Sequence
  Synthetic Oligonucleotide
ccuggaaauauauuaacuguuaaaaag

SEQ ID NO: 2217 - RNA, 27 nt, Artificial Sequence
  Synthetic Oligonucleotide
cuggaaauauauuaacuguuaaaaaga

SEQ ID NO: 2218 - RNA, 27 nt, Artificial Sequence
  Synthetic Oligonucleotide
uggaaauauauuaacuguuaaaaagaa

SEQ ID NO: 2219 - RNA, 27 nt, Artificial Sequence
  Synthetic Oligonucleotide
ggaaauauauuaacuguuaaaaagaaa

SEQ ID NO: 2220 - RNA, 27 nt, Artificial Sequence
  Synthetic Oligonucleotide
gaaauauauuaacuguuaaaaagaaaa

SEQ ID NO: 2221 - RNA, 27 nt, Artificial Sequence
  Synthetic Oligonucleotide
aaauauauuaacuguuaaaaagaaaac

SEQ ID NO: 2222 - RNA, 27 nt, Artificial Sequence
  Synthetic Oligonucleotide
aauauauuaacuguuaaaaagaaaaca

SEQ ID NO: 2223 - RNA, 27 nt, Artificial Sequence
  Synthetic Oligonucleotide
auauauuaacuguuaaaaagaaaacau

SEQ ID NO: 2224 - RNA, 27 nt, Artificial Sequence
  Synthetic Oligonucleotide
uauauuaacuguuaaaaagaaaacauu

SEQ ID NO: 2225 - RNA, 27 nt, Artificial Sequence
  Synthetic Oligonucleotide
auauuaacuguuaaaaagaaaacauug

SEQ ID NO: 2226 - RNA, 27 nt, Artificial Sequence
  Synthetic Oligonucleotide
uauuaacuguuaaaaagaaaacauuga

SEQ ID NO: 2227 - RNA, 27 nt, Artificial Sequence
  Synthetic Oligonucleotide
auuaacuguuaaaaagaaaacauugaa

SEQ ID NO: 2228 - RNA, 27 nt, Artificial Sequence
  Synthetic Oligonucleotide
uuaacuguuaaaaagaaaacauugaaa

SEQ ID NO: 2229 - RNA, 27 nt, Artificial Sequence
  Synthetic Oligonucleotide
uaacuguuaaaaagaaaacauugaaaa

SEQ ID NO: 2230 - RNA, 27 nt, Artificial Sequence
  Synthetic Oligonucleotide
aacuguuaaaaagaaaacauugaaaau

SEQ ID NO: 2231 - RNA, 27 nt, Artificial Sequence
  Synthetic Oligonucleotide
acuguuaaaaagaaaacauugaaaaug

SEQ ID NO: 2232 - RNA, 27 nt, Artificial Sequence
  Synthetic Oligonucleotide
cuguuaaaaagaaaacauugaaaaugu

SEQ ID NO: 2233 - RNA, 27 nt, Artificial Sequence
  Synthetic Oligonucleotide
uguuaaaaagaaaacauugaaaaugug

SEQ ID NO: 2234 - RNA, 27 nt, Artificial Sequence
  Synthetic Oligonucleotide
gacaacgucauccccuggcaggcuaaa

SEQ ID NO: 2235 - RNA, 27 nt, Artificial Sequence
  Synthetic Oligonucleotide
acaacgucauccccuggcaggcuaaag

SEQ ID NO: 2236 - RNA, 27 nt, Artificial Sequence
  Synthetic Oligonucleotide
caacgucauccccuggcaggcuaaagu

SEQ ID NO: 2237 - RNA, 27 nt, Artificial Sequence
  Synthetic Oligonucleotide
aacgucauccccuggcaggcuaaagug

SEQ ID NO: 2238 - RNA, 27 nt, Artificial Sequence
  Synthetic Oligonucleotide
acgucauccccuggcaggcuaaagugc

SEQ ID NO: 2239 - RNA, 27 nt, Artificial Sequence
  Synthetic Oligonucleotide
cgucauccccuggcaggcuaaagugcu

SEQ ID NO: 2240 - RNA, 27 nt, Artificial Sequence
  Synthetic Oligonucleotide
gucauccccuggcaggcuaaagugcug

SEQ ID NO: 2241 - RNA, 27 nt, Artificial Sequence
  Synthetic Oligonucleotide
ucauccccuggcaggcuaaagugcugu

SEQ ID NO: 2242 - RNA, 27 nt, Artificial Sequence
  Synthetic Oligonucleotide
cauccccuggcaggcuaaagugcugua

SEQ ID NO: 2243 - RNA, 27 nt, Artificial Sequence
  Synthetic Oligonucleotide
auccccuggcaggcuaaagugcuguau

SEQ ID NO: 2244 - RNA, 27 nt, Artificial Sequence
  Synthetic Oligonucleotide
uccccuggcaggcuaaagugcuguauc

SEQ ID NO: 2245 - RNA, 27 nt, Artificial Sequence
  Synthetic Oligonucleotide
ccccuggcaggcuaaagugcuguaucc

SEQ ID NO: 2246 - RNA, 27 nt, Artificial Sequence
  Synthetic Oligonucleotide
cccuggcaggcuaaagugcuguauccu

SEQ ID NO: 2247 - RNA, 27 nt, Artificial Sequence
  Synthetic Oligonucleotide
agguagcaaacacuaaggugaaaagau

SEQ ID NO: 2248 - RNA, 27 nt, Artificial Sequence
  Synthetic Oligonucleotide
gguagcaaacacuaaggugaaaagaua

SEQ ID NO: 2249 - RNA, 27 nt, Artificial Sequence
  Synthetic Oligonucleotide
guagcaaacacuaaggugaaaagauaa

SEQ ID NO: 2250 - RNA, 27 nt, Artificial Sequence
  Synthetic Oligonucleotide
uagcaaacacuaaggugaaaagauaau

SEQ ID NO: 2251 - RNA, 27 nt, Artificial Sequence
  Synthetic Oligonucleotide
gcaaacacuaaggugaaaagauaauga

SEQ ID NO: 2252 - RNA, 27 nt, Artificial Sequence
  Synthetic Oligonucleotide
caaacacuaaggugaaaagauaaugau

SEQ ID NO: 2253 - RNA, 27 nt, Artificial Sequence
  Synthetic Oligonucleotide
cacuaaggugaaaagauaaugaucuca

SEQ ID NO: 2254 - RNA, 27 nt, Artificial Sequence
  Synthetic Oligonucleotide
acuaaggugaaaagauaaugaucucau

SEQ ID NO: 2255 - RNA, 27 nt, Artificial Sequence
  Synthetic Oligonucleotide
cuaaggugaaaagauaaugaucucauu

SEQ ID NO: 2256 - RNA, 27 nt, Artificial Sequence
  Synthetic Oligonucleotide
uaaggugaaaagauaaugaucucauug

SEQ ID NO: 2257 - RNA, 27 nt, Artificial Sequence
  Synthetic Oligonucleotide
aaggugaaaagauaaugaucucauugu

SEQ ID NO: 2258 - RNA, 27 nt, Artificial Sequence
  Synthetic Oligonucleotide
aggugaaaagauaaugaucucauuguu

SEQ ID NO: 2259 - RNA, 27 nt, Artificial Sequence
  Synthetic Oligonucleotide
ggugaaaagauaaugaucucauuguuu

SEQ ID NO: 2260 - RNA, 27 nt, Artificial Sequence
  Synthetic Oligonucleotide
gugaaaagauaaugaucucauuguuua

SEQ ID NO: 2261 - RNA, 27 nt, Artificial Sequence
  Synthetic Oligonucleotide
ugaaaagauaaugaucucauuguuuau

SEQ ID NO: 2262 - RNA, 27 nt, Artificial Sequence
  Synthetic Oligonucleotide
gaaaagauaaugaucucauuguuuauu

SEQ ID NO: 2263 - RNA, 27 nt, Artificial Sequence
  Synthetic Oligonucleotide
aaaagauaaugaucucauuguuuauua

SEQ ID NO: 2264 - RNA, 27 nt, Artificial Sequence
  Synthetic Oligonucleotide
aaagauaaugaucucauuguuuauuaa

SEQ ID NO: 2265 - RNA, 27 nt, Artificial Sequence
  Synthetic Oligonucleotide
aagauaaugaucucauuguuuauuaac

SEQ ID NO: 2266 - RNA, 27 nt, Artificial Sequence
  Synthetic Oligonucleotide
agauaaugaucucauuguuuauuaacc

SEQ ID NO: 2267 - RNA, 27 nt, Artificial Sequence
  Synthetic Oligonucleotide
gauaaugaucucauuguuuauuaaccu

SEQ ID NO: 2268 - RNA, 27 nt, Artificial Sequence
  Synthetic Oligonucleotide
auaaugaucucauuguuuauuaaccug

SEQ ID NO: 2269 - RNA, 27 nt, Artificial Sequence
  Synthetic Oligonucleotide
uaaugaucucauuguuuauuaaccugu

SEQ ID NO: 2270 - RNA, 27 nt, Artificial Sequence
  Synthetic Oligonucleotide
aaugaucucauuguuuauuaaccugua

SEQ ID NO: 2271 - RNA, 27 nt, Artificial Sequence
  Synthetic Oligonucleotide
augaucucauuguuuauuaaccuguau

SEQ ID NO: 2272 - RNA, 27 nt, Artificial Sequence
  Synthetic Oligonucleotide
ugaucucauuguuuauuaaccuguauu

SEQ ID NO: 2273 - RNA, 27 nt, Artificial Sequence
  Synthetic Oligonucleotide
gaucucauuguuuauuaaccuguauuc

SEQ ID NO: 2274 - RNA, 27 nt, Artificial Sequence
  Synthetic Oligonucleotide
aucucauuguuuauuaaccuguauucu

SEQ ID NO: 2275 - RNA, 27 nt, Artificial Sequence
  Synthetic Oligonucleotide
ucucauuguuuauuaaccuguauucug

SEQ ID NO: 2276 - RNA, 27 nt, Artificial Sequence
  Synthetic Oligonucleotide
cucauuguuuauuaaccuguauucugu

SEQ ID NO: 2277 - RNA, 27 nt, Artificial Sequence
  Synthetic Oligonucleotide
ucauuguuuauuaaccuguauucuguu

SEQ ID NO: 2278 - RNA, 27 nt, Artificial Sequence
  Synthetic Oligonucleotide
uuguuuauuaaccuguauucuguuuac

SEQ ID NO: 2279 - RNA, 27 nt, Artificial Sequence
  Synthetic Oligonucleotide
uguuuauuaaccuguauucuguuuaca

SEQ ID NO: 2280 - RNA, 27 nt, Artificial Sequence
  Synthetic Oligonucleotide
uuauuaaccuguauucuguuuacaugu

SEQ ID NO: 2281 - RNA, 27 nt, Artificial Sequence
  Synthetic Oligonucleotide
uauuaaccuguauucuguuuacauguc

SEQ ID NO: 2282 - RNA, 27 nt, Artificial Sequence
  Synthetic Oligonucleotide
cuuuaaaacagugguucuuaaauugua

SEQ ID NO: 2283 - RNA, 27 nt, Artificial Sequence
  Synthetic Oligonucleotide
uuuaaaacagugguucuuaaauuguaa

SEQ ID NO: 2284 - RNA, 27 nt, Artificial Sequence
  Synthetic Oligonucleotide
uuaaaacagugguucuuaaauuguaag

SEQ ID NO: 2285 - RNA, 27 nt, Artificial Sequence
  Synthetic Oligonucleotide
uaaaacagugguucuuaaauuguaagc

SEQ ID NO: 2286 - RNA, 27 nt, Artificial Sequence
  Synthetic Oligonucleotide
aaaacagugguucuuaaauuguaagcu

SEQ ID NO: 2287 - RNA, 27 nt, Artificial Sequence
  Synthetic Oligonucleotide
aaacagugguucuuaaauuguaagcuc

SEQ ID NO: 2288 - RNA, 27 nt, Artificial Sequence
  Synthetic Oligonucleotide
aacagugguucuuaaauuguaagcuca

SEQ ID NO: 2289 - RNA, 27 nt, Artificial Sequence
  Synthetic Oligonucleotide
ugguucuuaaauuguaagcucagguuc

SEQ ID NO: 2290 - RNA, 27 nt, Artificial Sequence
  Synthetic Oligonucleotide
uucuuaaauuguaagcucagguucaaa

SEQ ID NO: 2291 - RNA, 27 nt, Artificial Sequence
  Synthetic Oligonucleotide
ucuuaaauuguaagcucagguucaaag

SEQ ID NO: 2292 - RNA, 27 nt, Artificial Sequence
  Synthetic Oligonucleotide
uuaaauuguaagcucagguucaaagug

SEQ ID NO: 2293 - RNA, 27 nt, Artificial Sequence
  Synthetic Oligonucleotide
uaaauuguaagcucagguucaaagugu

SEQ ID NO: 2294 - RNA, 27 nt, Artificial Sequence
  Synthetic Oligonucleotide
aaauuguaagcucagguucaaaguguu

SEQ ID NO: 2295 - RNA, 27 nt, Artificial Sequence
  Synthetic Oligonucleotide
uuggugauacuucuuugaauguagauu

SEQ ID NO: 2296 - RNA, 27 nt, Artificial Sequence
  Synthetic Oligonucleotide
caaucacaucuuuagugucugaauaua

SEQ ID NO: 2297 - RNA, 27 nt, Artificial Sequence
  Synthetic Oligonucleotide
uuuagugucugaauauauccaaauguu

SEQ ID NO: 2298 - RNA, 27 nt, Artificial Sequence
  Synthetic Oligonucleotide
uuagugucugaauauauccaaauguuu

SEQ ID NO: 2299 - RNA, 27 nt, Artificial Sequence
  Synthetic Oligonucleotide
uagugucugaauauauccaaauguuuu

SEQ ID NO: 2300 - RNA, 27 nt, Artificial Sequence
  Synthetic Oligonucleotide
gugucugaauauauccaaauguuuuag

SEQ ID NO: 2301 - RNA, 27 nt, Artificial Sequence
  Synthetic Oligonucleotide
ugucugaauauauccaaauguuuuagg

SEQ ID NO: 2302 - RNA, 27 nt, Artificial Sequence
  Synthetic Oligonucleotide
gucugaauauauccaaauguuuuagga

SEQ ID NO: 2303 - RNA, 27 nt, Artificial Sequence
  Synthetic Oligonucleotide
ucugaauauauccaaauguuuuaggau

SEQ ID NO: 2304 - RNA, 27 nt, Artificial Sequence
  Synthetic Oligonucleotide
cugaauauauccaaauguuuuaggaug

SEQ ID NO: 2305 - RNA, 19 nt, Artificial Sequence
  Synthetic Oligonucleotide
ggcuaauuuguaucaauga

SEQ ID NO: 2306 - RNA, 19 nt, Artificial Sequence
  Synthetic Oligonucleotide
gcuaauuuguaucaaugau

SEQ ID NO: 2307 - RNA, 19 nt, Artificial Sequence
  Synthetic Oligonucleotide
cuaauuuguaucaaugauu

SEQ ID NO: 2308 - RNA, 19 nt, Artificial Sequence
  Synthetic Oligonucleotide
uaauuuguaucaaugauua

SEQ ID NO: 2309 - RNA, 19 nt, Artificial Sequence
  Synthetic Oligonucleotide
aauuuguaucaaugauuau

SEQ ID NO: 2310 - RNA, 19 nt, Artificial Sequence
  Synthetic Oligonucleotide
auuuguaucaaugauuaug

SEQ ID NO: 2311 - RNA, 19 nt, Artificial Sequence
  Synthetic Oligonucleotide
uuuguaucaaugauuauga

SEQ ID NO: 2312 - RNA, 19 nt, Artificial Sequence
  Synthetic Oligonucleotide
uuguaucaaugauuaugaa

SEQ ID NO: 2313 - RNA, 19 nt, Artificial Sequence
  Synthetic Oligonucleotide
uguaucaaugauuaugaac

SEQ ID NO: 2314 - RNA, 19 nt, Artificial Sequence
  Synthetic Oligonucleotide
guaucaaugauuaugaaca

SEQ ID NO: 2315 - RNA, 19 nt, Artificial Sequence
  Synthetic Oligonucleotide
aucaaugauuaugaacaac

SEQ ID NO: 2316 - RNA, 19 nt, Artificial Sequence
  Synthetic Oligonucleotide
ucaaugauuaugaacaaca

SEQ ID NO: 2317 - RNA, 19 nt, Artificial Sequence
  Synthetic Oligonucleotide
caaugauuaugaacaacau

SEQ ID NO: 2318 - RNA, 19 nt, Artificial Sequence
  Synthetic Oligonucleotide
aaugauuaugaacaacaug

SEQ ID NO: 2319 - RNA, 19 nt, Artificial Sequence
  Synthetic Oligonucleotide
augauuaugaacaacaugc

SEQ ID NO: 2320 - RNA, 19 nt, Artificial Sequence
  Synthetic Oligonucleotide
ugauuaugaacaacaugcu

SEQ ID NO: 2321 - RNA, 19 nt, Artificial Sequence
  Synthetic Oligonucleotide
gauuaugaacaacaugcua

SEQ ID NO: 2322 - RNA, 19 nt, Artificial Sequence
  Synthetic Oligonucleotide
auuaugaacaacaugcuaa

SEQ ID NO: 2323 - RNA, 19 nt, Artificial Sequence
  Synthetic Oligonucleotide
augaacaacaugcuaaauc

SEQ ID NO: 2324 - RNA, 19 nt, Artificial Sequence
  Synthetic Oligonucleotide
gaacaacaugcuaaaucag

SEQ ID NO: 2325 - RNA, 19 nt, Artificial Sequence
  Synthetic Oligonucleotide
aacaacaugcuaaaucagu

SEQ ID NO: 2326 - RNA, 19 nt, Artificial Sequence
  Synthetic Oligonucleotide
aacaugcuaaaucaguacu

SEQ ID NO: 2327 - RNA, 19 nt, Artificial Sequence
  Synthetic Oligonucleotide
aaucaguacuuccaaaguc

SEQ ID NO: 2328 - RNA, 19 nt, Artificial Sequence
  Synthetic Oligonucleotide
aucaguacuuccaaagucu

SEQ ID NO: 2329 - RNA, 19 nt, Artificial Sequence
  Synthetic Oligonucleotide
caguacuuccaaagucuau

SEQ ID NO: 2330 - RNA, 19 nt, Artificial Sequence
  Synthetic Oligonucleotide
aguacuuccaaagucuaua

SEQ ID NO: 2331 - RNA, 19 nt, Artificial Sequence
  Synthetic Oligonucleotide
guacuuccaaagucuauau

SEQ ID NO: 2332 - RNA, 19 nt, Artificial Sequence
  Synthetic Oligonucleotide
cuuccaaagucuauauaug

SEQ ID NO: 2333 - RNA, 19 nt, Artificial Sequence
  Synthetic Oligonucleotide
ccaaagucuauauaugacu

SEQ ID NO: 2334 - RNA, 19 nt, Artificial Sequence
  Synthetic Oligonucleotide
caaagucuauauaugacua

SEQ ID NO: 2335 - RNA, 19 nt, Artificial Sequence
  Synthetic Oligonucleotide
aagucuauauaugacuauu

SEQ ID NO: 2336 - RNA, 19 nt, Artificial Sequence
  Synthetic Oligonucleotide
uaugacuauuacaggucug

SEQ ID NO: 2337 - RNA, 19 nt, Artificial Sequence
  Synthetic Oligonucleotide
augacuauuacaggucugg

SEQ ID NO: 2338 - RNA, 19 nt, Artificial Sequence
  Synthetic Oligonucleotide
ugacuauuacaggucuggg

SEQ ID NO: 2339 - RNA, 19 nt, Artificial Sequence
  Synthetic Oligonucleotide
gacuauuacaggucugggg

SEQ ID NO: 2340 - RNA, 19 nt, Artificial Sequence
  Synthetic Oligonucleotide
acuauuacaggucuggggc

SEQ ID NO: 2341 - RNA, 19 nt, Artificial Sequence
  Synthetic Oligonucleotide
cuauuacaggucuggggca

SEQ ID NO: 2342 - RNA, 19 nt, Artificial Sequence
  Synthetic Oligonucleotide
uauuacaggucuggggcaa

SEQ ID NO: 2343 - RNA, 19 nt, Artificial Sequence
  Synthetic Oligonucleotide
auuacaggucuggggcaaa

SEQ ID NO: 2344 - RNA, 19 nt, Artificial Sequence
  Synthetic Oligonucleotide
uuacaggucuggggcaaau

SEQ ID NO: 2345 - RNA, 19 nt, Artificial Sequence
  Synthetic Oligonucleotide
uacaggucuggggcaaaug

SEQ ID NO: 2346 - RNA, 19 nt, Artificial Sequence
  Synthetic Oligonucleotide
acaggucuggggcaaauga

SEQ ID NO: 2347 - RNA, 19 nt, Artificial Sequence
  Synthetic Oligonucleotide
caggucuggggcaaaugau

SEQ ID NO: 2348 - RNA, 19 nt, Artificial Sequence
  Synthetic Oligonucleotide
ggaauguugcugaaacaga

SEQ ID NO: 2349 - RNA, 19 nt, Artificial Sequence
  Synthetic Oligonucleotide
acuucuguuuuaggacaga

SEQ ID NO: 2350 - RNA, 19 nt, Artificial Sequence
  Synthetic Oligonucleotide
cuucuguuuuaggacagag

SEQ ID NO: 2351 - RNA, 19 nt, Artificial Sequence
  Synthetic Oligonucleotide
uacaaggccauauuuguga

SEQ ID NO: 2352 - RNA, 19 nt, Artificial Sequence
  Synthetic Oligonucleotide
acaaggccauauuugugac

SEQ ID NO: 2353 - RNA, 19 nt, Artificial Sequence
  Synthetic Oligonucleotide
ccacaacucaggaugaaaa

SEQ ID NO: 2354 - RNA, 19 nt, Artificial Sequence
  Synthetic Oligonucleotide
cacaacucaggaugaaaaa

SEQ ID NO: 2355 - RNA, 19 nt, Artificial Sequence
  Synthetic Oligonucleotide
acaacucaggaugaaaaau

SEQ ID NO: 2356 - RNA, 19 nt, Artificial Sequence
  Synthetic Oligonucleotide
caacucaggaugaaaaauu

SEQ ID NO: 2357 - RNA, 19 nt, Artificial Sequence
  Synthetic Oligonucleotide
aacucaggaugaaaaauuu

SEQ ID NO: 2358 - RNA, 19 nt, Artificial Sequence
  Synthetic Oligonucleotide
cucaggaugaaaaauuuug

SEQ ID NO: 2359 - RNA, 19 nt, Artificial Sequence
  Synthetic Oligonucleotide
ucaggaugaaaaauuuuga

SEQ ID NO: 2360 - RNA, 19 nt, Artificial Sequence
  Synthetic Oligonucleotide
caggaugaaaaauuuugaa

SEQ ID NO: 2361 - RNA, 19 nt, Artificial Sequence
  Synthetic Oligonucleotide
aggaugaaaaauuuugaaa

SEQ ID NO: 2362 - RNA, 19 nt, Artificial Sequence
  Synthetic Oligonucleotide
gaugaaaaauuuugaaacc

SEQ ID NO: 2363 - RNA, 19 nt, Artificial Sequence
  Synthetic Oligonucleotide
augaaaaauuuugaaacca

SEQ ID NO: 2364 - RNA, 19 nt, Artificial Sequence
  Synthetic Oligonucleotide
ugaaaaauuuugaaaccag

SEQ ID NO: 2365 - RNA, 19 nt, Artificial Sequence
  Synthetic Oligonucleotide
gaaaaauuuugaaaccagu

SEQ ID NO: 2366 - RNA, 19 nt, Artificial Sequence
  Synthetic Oligonucleotide
aaaaauuuugaaaccagua

SEQ ID NO: 2367 - RNA, 19 nt, Artificial Sequence
  Synthetic Oligonucleotide
aaaauuuugaaaccaguac

SEQ ID NO: 2368 - RNA, 19 nt, Artificial Sequence
  Synthetic Oligonucleotide
aaauuuugaaaccaguacu

SEQ ID NO: 2369 - RNA, 19 nt, Artificial Sequence
  Synthetic Oligonucleotide
aauuuugaaaccaguacuu

SEQ ID NO: 2370 - RNA, 19 nt, Artificial Sequence
  Synthetic Oligonucleotide
auuuugaaaccaguacuuu

SEQ ID NO: 2371 - RNA, 19 nt, Artificial Sequence
  Synthetic Oligonucleotide
uuuugaaaccaguacuuua

SEQ ID NO: 2372 - RNA, 19 nt, Artificial Sequence
  Synthetic Oligonucleotide
uuugaaaccaguacuuuau

SEQ ID NO: 2373 - RNA, 19 nt, Artificial Sequence
  Synthetic Oligonucleotide
uugaaaccaguacuuuauc

SEQ ID NO: 2374 - RNA, 19 nt, Artificial Sequence
  Synthetic Oligonucleotide
ugaaaccaguacuuuauca

SEQ ID NO: 2375 - RNA, 19 nt, Artificial Sequence
  Synthetic Oligonucleotide
gaaaccaguacuuuaucau

SEQ ID NO: 2376 - RNA, 19 nt, Artificial Sequence
  Synthetic Oligonucleotide
aaaccaguacuuuaucauu

SEQ ID NO: 2377 - RNA, 19 nt, Artificial Sequence
  Synthetic Oligonucleotide
aaccaguacuuuaucauuu

SEQ ID NO: 2378 - RNA, 19 nt, Artificial Sequence
  Synthetic Oligonucleotide
ccaguacuuuaucauuuuc

SEQ ID NO: 2379 - RNA, 19 nt, Artificial Sequence
  Synthetic Oligonucleotide
caguacuuuaucauuuucu

SEQ ID NO: 2380 - RNA, 19 nt, Artificial Sequence
  Synthetic Oligonucleotide
aucauuuucuccugaggaa

SEQ ID NO: 2381 - RNA, 19 nt, Artificial Sequence
  Synthetic Oligonucleotide
aauggcugagaagacugac

SEQ ID NO: 2382 - RNA, 19 nt, Artificial Sequence
  Synthetic Oligonucleotide
aaagggcauuuugagaggu

SEQ ID NO: 2383 - RNA, 19 nt, Artificial Sequence
  Synthetic Oligonucleotide
aagggcauuuugagaggug

SEQ ID NO: 2384 - RNA, 19 nt, Artificial Sequence
  Synthetic Oligonucleotide
agggcauuuugagagguga

SEQ ID NO: 2385 - RNA, 19 nt, Artificial Sequence
  Synthetic Oligonucleotide
gggcauuuugagaggugau

SEQ ID NO: 2386 - RNA, 19 nt, Artificial Sequence
  Synthetic Oligonucleotide
ggcauuuugagaggugaug

SEQ ID NO: 2387 - RNA, 19 nt, Artificial Sequence
  Synthetic Oligonucleotide
gcauuuugagaggugauga

SEQ ID NO: 2388 - RNA, 19 nt, Artificial Sequence
  Synthetic Oligonucleotide
cauuuugagaggugaugau

SEQ ID NO: 2389 - RNA, 19 nt, Artificial Sequence
  Synthetic Oligonucleotide
auuuugagaggugaugaug

SEQ ID NO: 2390 - RNA, 19 nt, Artificial Sequence
  Synthetic Oligonucleotide
uuuugagaggugaugaugc

SEQ ID NO: 2391 - RNA, 19 nt, Artificial Sequence
  Synthetic Oligonucleotide
uuugagaggugaugaugcc

SEQ ID NO: 2392 - RNA, 19 nt, Artificial Sequence
  Synthetic Oligonucleotide
uugagaggugaugaugcca

SEQ ID NO: 2393 - RNA, 19 nt, Artificial Sequence
  Synthetic Oligonucleotide
augggaucuuggugucgaa

SEQ ID NO: 2394 - RNA, 19 nt, Artificial Sequence
  Synthetic Oligonucleotide
ugggaucuuggugucgaau

SEQ ID NO: 2395 - RNA, 19 nt, Artificial Sequence
  Synthetic Oligonucleotide
gggaucuuggugucgaauc

SEQ ID NO: 2396 - RNA, 19 nt, Artificial Sequence
  Synthetic Oligonucleotide
ggaucuuggugucgaauca

SEQ ID NO: 2397 - RNA, 19 nt, Artificial Sequence
  Synthetic Oligonucleotide
gaucuuggugucgaaucau

SEQ ID NO: 2398 - RNA, 19 nt, Artificial Sequence
  Synthetic Oligonucleotide
aucuuggugucgaaucaug

SEQ ID NO: 2399 - RNA, 19 nt, Artificial Sequence
  Synthetic Oligonucleotide
ucuuggugucgaaucaugg

SEQ ID NO: 2400 - RNA, 19 nt, Artificial Sequence
  Synthetic Oligonucleotide
cuuggugucgaaucauggg

SEQ ID NO: 2401 - RNA, 19 nt, Artificial Sequence
  Synthetic Oligonucleotide
uuggugucgaaucaugggg

SEQ ID NO: 2402 - RNA, 19 nt, Artificial Sequence
  Synthetic Oligonucleotide
uggugucgaaucauggggc

SEQ ID NO: 2403 - RNA, 19 nt, Artificial Sequence
  Synthetic Oligonucleotide
ccacuauugauguucugcc

SEQ ID NO: 2404 - RNA, 19 nt, Artificial Sequence
  Synthetic Oligonucleotide
cuauugauguucugccaga

SEQ ID NO: 2405 - RNA, 19 nt, Artificial Sequence
  Synthetic Oligonucleotide
uauugauguucugccagaa

SEQ ID NO: 2406 - RNA, 19 nt, Artificial Sequence
  Synthetic Oligonucleotide
gaggcuguggaagggaagg

SEQ ID NO: 2407 - RNA, 19 nt, Artificial Sequence
  Synthetic Oligonucleotide
aggcuguggaagggaaggu

SEQ ID NO: 2408 - RNA, 19 nt, Artificial Sequence
  Synthetic Oligonucleotide
ggagaaagguguucaagau

SEQ ID NO: 2409 - RNA, 19 nt, Artificial Sequence
  Synthetic Oligonucleotide
gagaaagguguucaagaug

SEQ ID NO: 2410 - RNA, 19 nt, Artificial Sequence
  Synthetic Oligonucleotide
agaaagguguucaagaugu

SEQ ID NO: 2411 - RNA, 19 nt, Artificial Sequence
  Synthetic Oligonucleotide
gaaagguguucaagauguc

SEQ ID NO: 2412 - RNA, 19 nt, Artificial Sequence
  Synthetic Oligonucleotide
aaagguguucaagaugucc

SEQ ID NO: 2413 - RNA, 19 nt, Artificial Sequence
  Synthetic Oligonucleotide
aagguguucaagauguccu

SEQ ID NO: 2414 - RNA, 19 nt, Artificial Sequence
  Synthetic Oligonucleotide
agguguucaagauguccuc

SEQ ID NO: 2415 - RNA, 19 nt, Artificial Sequence
  Synthetic Oligonucleotide
gguguucaagauguccucg

SEQ ID NO: 2416 - RNA, 19 nt, Artificial Sequence
  Synthetic Oligonucleotide
guguucaagauguccucga

SEQ ID NO: 2417 - RNA, 19 nt, Artificial Sequence
  Synthetic Oligonucleotide
uguucaagauguccucgag

SEQ ID NO: 2418 - RNA, 19 nt, Artificial Sequence
  Synthetic Oligonucleotide
guucaagauguccucgaga

SEQ ID NO: 2419 - RNA, 19 nt, Artificial Sequence
  Synthetic Oligonucleotide
uucaagauguccucgagau

SEQ ID NO: 2420 - RNA, 19 nt, Artificial Sequence
  Synthetic Oligonucleotide
ucaagauguccucgagaua

SEQ ID NO: 2421 - RNA, 19 nt, Artificial Sequence
  Synthetic Oligonucleotide
uggccauggcucugagugg

SEQ ID NO: 2422 - RNA, 19 nt, Artificial Sequence
  Synthetic Oligonucleotide
ggccauggcucugaguggg

SEQ ID NO: 2423 - RNA, 19 nt, Artificial Sequence
  Synthetic Oligonucleotide
gccauggcucugagugggu

SEQ ID NO: 2424 - RNA, 19 nt, Artificial Sequence
  Synthetic Oligonucleotide
ccauggcucugagugggug

SEQ ID NO: 2425 - RNA, 19 nt, Artificial Sequence
  Synthetic Oligonucleotide
cauggcucugagugggugc

SEQ ID NO: 2426 - RNA, 19 nt, Artificial Sequence
  Synthetic Oligonucleotide
auggcucugagugggugcc

SEQ ID NO: 2427 - RNA, 19 nt, Artificial Sequence
  Synthetic Oligonucleotide
uggcucugagugggugcca

SEQ ID NO: 2428 - RNA, 19 nt, Artificial Sequence
  Synthetic Oligonucleotide
ggcucugagugggugccag

SEQ ID NO: 2429 - RNA, 19 nt, Artificial Sequence
  Synthetic Oligonucleotide
gcucugagugggugccaga

SEQ ID NO: 2430 - RNA, 19 nt, Artificial Sequence
  Synthetic Oligonucleotide
cucugagugggugccagaa

SEQ ID NO: 2431 - RNA, 19 nt, Artificial Sequence
  Synthetic Oligonucleotide
ucugagugggugccagaau

SEQ ID NO: 2432 - RNA, 19 nt, Artificial Sequence
  Synthetic Oligonucleotide
cugagugggugccagaaug

SEQ ID NO: 2433 - RNA, 19 nt, Artificial Sequence
  Synthetic Oligonucleotide
ugagugggugccagaaugu

SEQ ID NO: 2434 - RNA, 19 nt, Artificial Sequence
  Synthetic Oligonucleotide
gagugggugccagaaugug

SEQ ID NO: 2435 - RNA, 19 nt, Artificial Sequence
  Synthetic Oligonucleotide
agugggugccagaauguga

SEQ ID NO: 2436 - RNA, 19 nt, Artificial Sequence
  Synthetic Oligonucleotide
gugggugccagaaugugaa

SEQ ID NO: 2437 - RNA, 19 nt, Artificial Sequence
  Synthetic Oligonucleotide
ugggugccagaaugugaaa

SEQ ID NO: 2438 - RNA, 19 nt, Artificial Sequence
  Synthetic Oligonucleotide
gggugccagaaugugaaag

SEQ ID NO: 2439 - RNA, 19 nt, Artificial Sequence
  Synthetic Oligonucleotide
ggugccagaaugugaaagu

SEQ ID NO: 2440 - RNA, 19 nt, Artificial Sequence
  Synthetic Oligonucleotide
gugccagaaugugaaaguc

SEQ ID NO: 2441 - RNA, 19 nt, Artificial Sequence
  Synthetic Oligonucleotide
ugccagaaugugaaaguca

SEQ ID NO: 2442 - RNA, 19 nt, Artificial Sequence
  Synthetic Oligonucleotide
gccagaaugugaaagucau

SEQ ID NO: 2443 - RNA, 19 nt, Artificial Sequence
  Synthetic Oligonucleotide
ccagaaugugaaagucauc

SEQ ID NO: 2444 - RNA, 19 nt, Artificial Sequence
  Synthetic Oligonucleotide
cagaaugugaaagucaucg

SEQ ID NO: 2445 - RNA, 19 nt, Artificial Sequence
  Synthetic Oligonucleotide
agaaugugaaagucaucga

SEQ ID NO: 2446 - RNA, 19 nt, Artificial Sequence
  Synthetic Oligonucleotide
gaaugugaaagucaucgac

SEQ ID NO: 2447 - RNA, 19 nt, Artificial Sequence
  Synthetic Oligonucleotide
aaugugaaagucaucgaca

SEQ ID NO: 2448 - RNA, 19 nt, Artificial Sequence
  Synthetic Oligonucleotide
augugaaagucaucgacaa

SEQ ID NO: 2449 - RNA, 19 nt, Artificial Sequence
  Synthetic Oligonucleotide
ugugaaagucaucgacaag

SEQ ID NO: 2450 - RNA, 19 nt, Artificial Sequence
  Synthetic Oligonucleotide
gugaaagucaucgacaaga

SEQ ID NO: 2451 - RNA, 19 nt, Artificial Sequence
  Synthetic Oligonucleotide
ugaaagucaucgacaagac

SEQ ID NO: 2452 - RNA, 19 nt, Artificial Sequence
  Synthetic Oligonucleotide
gaaagucaucgacaagaca

SEQ ID NO: 2453 - RNA, 19 nt, Artificial Sequence
  Synthetic Oligonucleotide
aaagucaucgacaagacau

SEQ ID NO: 2454 - RNA, 19 nt, Artificial Sequence
  Synthetic Oligonucleotide
aagucaucgacaagacauu

SEQ ID NO: 2455 - RNA, 19 nt, Artificial Sequence
  Synthetic Oligonucleotide
agucaucgacaagacauug

SEQ ID NO: 2456 - RNA, 19 nt, Artificial Sequence
  Synthetic Oligonucleotide
gucaucgacaagacauugg

SEQ ID NO: 2457 - RNA, 19 nt, Artificial Sequence
  Synthetic Oligonucleotide
ucaucgacaagacauuggu

SEQ ID NO: 2458 - RNA, 19 nt, Artificial Sequence
  Synthetic Oligonucleotide
caucgacaagacauuggug

SEQ ID NO: 2459 - RNA, 19 nt, Artificial Sequence
  Synthetic Oligonucleotide
aucgacaagacauugguga

SEQ ID NO: 2460 - RNA, 19 nt, Artificial Sequence
  Synthetic Oligonucleotide
ucgacaagacauuggugag

SEQ ID NO: 2461 - RNA, 19 nt, Artificial Sequence
  Synthetic Oligonucleotide
cgacaagacauuggugagg

SEQ ID NO: 2462 - RNA, 19 nt, Artificial Sequence
  Synthetic Oligonucleotide
gacaagacauuggugagga

SEQ ID NO: 2463 - RNA, 19 nt, Artificial Sequence
  Synthetic Oligonucleotide
acaagacauuggugaggaa

SEQ ID NO: 2464 - RNA, 19 nt, Artificial Sequence
  Synthetic Oligonucleotide
caagacauuggugaggaaa

SEQ ID NO: 2465 - RNA, 19 nt, Artificial Sequence
  Synthetic Oligonucleotide
aagacauuggugaggaaaa

SEQ ID NO: 2466 - RNA, 19 nt, Artificial Sequence
  Synthetic Oligonucleotide
agacauuggugaggaaaaa

SEQ ID NO: 2467 - RNA, 19 nt, Artificial Sequence
  Synthetic Oligonucleotide
gacauuggugaggaaaaau

SEQ ID NO: 2468 - RNA, 19 nt, Artificial Sequence
  Synthetic Oligonucleotide
acauuggugaggaaaaauc

SEQ ID NO: 2469 - RNA, 19 nt, Artificial Sequence
  Synthetic Oligonucleotide
cauuggugaggaaaaaucc

SEQ ID NO: 2470 - RNA, 19 nt, Artificial Sequence
  Synthetic Oligonucleotide
auuggugaggaaaaauccu

SEQ ID NO: 2471 - RNA, 19 nt, Artificial Sequence
  Synthetic Oligonucleotide
uuggugaggaaaaauccuu

SEQ ID NO: 2472 - RNA, 19 nt, Artificial Sequence
  Synthetic Oligonucleotide
uggugaggaaaaauccuuu

SEQ ID NO: 2473 - RNA, 19 nt, Artificial Sequence
  Synthetic Oligonucleotide
ggugaggaaaaauccuuug

SEQ ID NO: 2474 - RNA, 19 nt, Artificial Sequence
  Synthetic Oligonucleotide
gugaggaaaaauccuuugg

SEQ ID NO: 2475 - RNA, 19 nt, Artificial Sequence
  Synthetic Oligonucleotide
ugaggaaaaauccuuuggc

SEQ ID NO: 2476 - RNA, 19 nt, Artificial Sequence
  Synthetic Oligonucleotide
guuuccaagaucugacagu

SEQ ID NO: 2477 - RNA, 19 nt, Artificial Sequence
  Synthetic Oligonucleotide
uuuccaagaucugacagug

SEQ ID NO: 2478 - RNA, 19 nt, Artificial Sequence
  Synthetic Oligonucleotide
uuccaagaucugacagugc

SEQ ID NO: 2479 - RNA, 19 nt, Artificial Sequence
  Synthetic Oligonucleotide
uccaagaucugacagugca

SEQ ID NO: 2480 - RNA, 19 nt, Artificial Sequence
  Synthetic Oligonucleotide
ccaagaucugacagugcac

SEQ ID NO: 2481 - RNA, 19 nt, Artificial Sequence
  Synthetic Oligonucleotide
caagaucugacagugcaca

SEQ ID NO: 2482 - RNA, 19 nt, Artificial Sequence
  Synthetic Oligonucleotide
aagaucugacagugcacaa

SEQ ID NO: 2483 - RNA, 19 nt, Artificial Sequence
  Synthetic Oligonucleotide
agaucugacagugcacaau

SEQ ID NO: 2484 - RNA, 19 nt, Artificial Sequence
  Synthetic Oligonucleotide
gaucugacagugcacaaua

SEQ ID NO: 2485 - RNA, 19 nt, Artificial Sequence
  Synthetic Oligonucleotide
aucugacagugcacaauau

SEQ ID NO: 2486 - RNA, 19 nt, Artificial Sequence
  Synthetic Oligonucleotide
ucugacagugcacaauauu

SEQ ID NO: 2487 - RNA, 19 nt, Artificial Sequence
  Synthetic Oligonucleotide
cugacagugcacaauauuu

SEQ ID NO: 2488 - RNA, 19 nt, Artificial Sequence
  Synthetic Oligonucleotide
ugacagugcacaauauuuu

SEQ ID NO: 2489 - RNA, 19 nt, Artificial Sequence
  Synthetic Oligonucleotide
gacagugcacaauauuuuc

SEQ ID NO: 2490 - RNA, 19 nt, Artificial Sequence
  Synthetic Oligonucleotide
acagugcacaauauuuucc

SEQ ID NO: 2491 - RNA, 19 nt, Artificial Sequence
  Synthetic Oligonucleotide
cagugcacaauauuuuccc

SEQ ID NO: 2492 - RNA, 19 nt, Artificial Sequence
  Synthetic Oligonucleotide
agugcacaauauuuuccca

SEQ ID NO: 2493 - RNA, 19 nt, Artificial Sequence
  Synthetic Oligonucleotide
gugcacaauauuuucccau

SEQ ID NO: 2494 - RNA, 19 nt, Artificial Sequence
  Synthetic Oligonucleotide
ugcacaauauuuucccauc

SEQ ID NO: 2495 - RNA, 19 nt, Artificial Sequence
  Synthetic Oligonucleotide
gcacaauauuuucccaucu

SEQ ID NO: 2496 - RNA, 19 nt, Artificial Sequence
  Synthetic Oligonucleotide
cacaauauuuucccaucug

SEQ ID NO: 2497 - RNA, 19 nt, Artificial Sequence
  Synthetic Oligonucleotide
acaauauuuucccaucugu

SEQ ID NO: 2498 - RNA, 19 nt, Artificial Sequence
  Synthetic Oligonucleotide
caauauuuucccaucugua

SEQ ID NO: 2499 - RNA, 19 nt, Artificial Sequence
  Synthetic Oligonucleotide
aauauuuucccaucuguau

SEQ ID NO: 2500 - RNA, 19 nt, Artificial Sequence
  Synthetic Oligonucleotide
auauuuucccaucuguauu

SEQ ID NO: 2501 - RNA, 19 nt, Artificial Sequence
  Synthetic Oligonucleotide
uauuuucccaucuguauua

SEQ ID NO: 2502 - RNA, 19 nt, Artificial Sequence
  Synthetic Oligonucleotide
auuuucccaucuguauuau

SEQ ID NO: 2503 - RNA, 19 nt, Artificial Sequence
  Synthetic Oligonucleotide
uuuuucagcauguauuacu

SEQ ID NO: 2504 - RNA, 19 nt, Artificial Sequence
  Synthetic Oligonucleotide
uuuucagcauguauuacuu

SEQ ID NO: 2505 - RNA, 19 nt, Artificial Sequence
  Synthetic Oligonucleotide
uuucagcauguauuacuug

SEQ ID NO: 2506 - RNA, 19 nt, Artificial Sequence
  Synthetic Oligonucleotide
uucagcauguauuacuuga

SEQ ID NO: 2507 - RNA, 19 nt, Artificial Sequence
  Synthetic Oligonucleotide
ucagcauguauuacuugac

SEQ ID NO: 2508 - RNA, 19 nt, Artificial Sequence
  Synthetic Oligonucleotide
cagcauguauuacuugaca

SEQ ID NO: 2509 - RNA, 19 nt, Artificial Sequence
  Synthetic Oligonucleotide
agcauguauuacuugacaa

SEQ ID NO: 2510 - RNA, 19 nt, Artificial Sequence
  Synthetic Oligonucleotide
gcauguauuacuugacaaa

SEQ ID NO: 2511 - RNA, 19 nt, Artificial Sequence
  Synthetic Oligonucleotide
cauguauuacuugacaaag

SEQ ID NO: 2512 - RNA, 19 nt, Artificial Sequence
  Synthetic Oligonucleotide
uauuacuugacaaagagac

SEQ ID NO: 2513 - RNA, 19 nt, Artificial Sequence
  Synthetic Oligonucleotide
auuacuugacaaagagaca

SEQ ID NO: 2514 - RNA, 19 nt, Artificial Sequence
  Synthetic Oligonucleotide
uuacuugacaaagagacac

SEQ ID NO: 2515 - RNA, 19 nt, Artificial Sequence
  Synthetic Oligonucleotide
uacuugacaaagagacacu

SEQ ID NO: 2516 - RNA, 19 nt, Artificial Sequence
  Synthetic Oligonucleotide
acuugacaaagagacacug

SEQ ID NO: 2517 - RNA, 19 nt, Artificial Sequence
  Synthetic Oligonucleotide
cuugacaaagagacacugu

SEQ ID NO: 2518 - RNA, 19 nt, Artificial Sequence
  Synthetic Oligonucleotide
uugacaaagagacacugug

SEQ ID NO: 2519 - RNA, 19 nt, Artificial Sequence
  Synthetic Oligonucleotide
ugacaaagagacacugugc

SEQ ID NO: 2520 - RNA, 19 nt, Artificial Sequence
  Synthetic Oligonucleotide
gacaaagagacacugugca

SEQ ID NO: 2521 - RNA, 19 nt, Artificial Sequence
  Synthetic Oligonucleotide
acaaagagacacugugcag

SEQ ID NO: 2522 - RNA, 19 nt, Artificial Sequence
  Synthetic Oligonucleotide
caaagagacacugugcaga

SEQ ID NO: 2523 - RNA, 19 nt, Artificial Sequence
  Synthetic Oligonucleotide
aaagagacacugugcagag

SEQ ID NO: 2524 - RNA, 19 nt, Artificial Sequence
  Synthetic Oligonucleotide
aagagacacugugcagagg

SEQ ID NO: 2525 - RNA, 19 nt, Artificial Sequence
  Synthetic Oligonucleotide
agagacacugugcagaggg

SEQ ID NO: 2526 - RNA, 19 nt, Artificial Sequence
  Synthetic Oligonucleotide
gagacacugugcagagggu

SEQ ID NO: 2527 - RNA, 19 nt, Artificial Sequence
  Synthetic Oligonucleotide
agacacugugcagagggug

SEQ ID NO: 2528 - RNA, 19 nt, Artificial Sequence
  Synthetic Oligonucleotide
gacacugugcagaggguga

SEQ ID NO: 2529 - RNA, 19 nt, Artificial Sequence
  Synthetic Oligonucleotide
acacugugcagagggugac

SEQ ID NO: 2530 - RNA, 19 nt, Artificial Sequence
  Synthetic Oligonucleotide
cacugugcagagggugacc

SEQ ID NO: 2531 - RNA, 19 nt, Artificial Sequence
  Synthetic Oligonucleotide
acugugcagagggugacca

SEQ ID NO: 2532 - RNA, 19 nt, Artificial Sequence
  Synthetic Oligonucleotide
cugugcagagggugaccac

SEQ ID NO: 2533 - RNA, 19 nt, Artificial Sequence
  Synthetic Oligonucleotide
ugugcagagggugaccaca

SEQ ID NO: 2534 - RNA, 19 nt, Artificial Sequence
  Synthetic Oligonucleotide
gugcagagggugaccacag

SEQ ID NO: 2535 - RNA, 19 nt, Artificial Sequence
  Synthetic Oligonucleotide
gucuguaauuccccacuuc

SEQ ID NO: 2536 - RNA, 19 nt, Artificial Sequence
  Synthetic Oligonucleotide
ucuguaauuccccacuuca

SEQ ID NO: 2537 - RNA, 19 nt, Artificial Sequence
  Synthetic Oligonucleotide
cuguaauuccccacuucaa

SEQ ID NO: 2538 - RNA, 19 nt, Artificial Sequence
  Synthetic Oligonucleotide
uguaauuccccacuucaau

SEQ ID NO: 2539 - RNA, 19 nt, Artificial Sequence
  Synthetic Oligonucleotide
auacaaagggugucguucu

SEQ ID NO: 2540 - RNA, 19 nt, Artificial Sequence
  Synthetic Oligonucleotide
uacaaagggugucguucuu

SEQ ID NO: 2541 - RNA, 19 nt, Artificial Sequence
  Synthetic Oligonucleotide
acaaagggugucguucuuu

SEQ ID NO: 2542 - RNA, 19 nt, Artificial Sequence
  Synthetic Oligonucleotide
caaagggugucguucuuuu

SEQ ID NO: 2543 - RNA, 19 nt, Artificial Sequence
  Synthetic Oligonucleotide
aaagggugucguucuuuuc

SEQ ID NO: 2544 - RNA, 19 nt, Artificial Sequence
  Synthetic Oligonucleotide
aagggugucguucuuuucc

SEQ ID NO: 2545 - RNA, 19 nt, Artificial Sequence
  Synthetic Oligonucleotide
agggugucguucuuuucca

SEQ ID NO: 2546 - RNA, 19 nt, Artificial Sequence
  Synthetic Oligonucleotide
gggugucguucuuuuccaa

SEQ ID NO: 2547 - RNA, 19 nt, Artificial Sequence
  Synthetic Oligonucleotide
ggugucguucuuuuccaac

SEQ ID NO: 2548 - RNA, 19 nt, Artificial Sequence
  Synthetic Oligonucleotide
gugucguucuuuuccaaca

SEQ ID NO: 2549 - RNA, 19 nt, Artificial Sequence
  Synthetic Oligonucleotide
ugucguucuuuuccaacaa

SEQ ID NO: 2550 - RNA, 19 nt, Artificial Sequence
  Synthetic Oligonucleotide
gucguucuuuuccaacaaa

SEQ ID NO: 2551 - RNA, 19 nt, Artificial Sequence
  Synthetic Oligonucleotide
ucguucuuuuccaacaaaa

SEQ ID NO: 2552 - RNA, 19 nt, Artificial Sequence
  Synthetic Oligonucleotide
cguucuuuuccaacaaaau

SEQ ID NO: 2553 - RNA, 19 nt, Artificial Sequence
  Synthetic Oligonucleotide
guucuuuuccaacaaaaua

SEQ ID NO: 2554 - RNA, 19 nt, Artificial Sequence
  Synthetic Oligonucleotide
uucuuuuccaacaaaauag

SEQ ID NO: 2555 - RNA, 19 nt, Artificial Sequence
  Synthetic Oligonucleotide
ucuuuuccaacaaaauagc

SEQ ID NO: 2556 - RNA, 19 nt, Artificial Sequence
  Synthetic Oligonucleotide
caacaaaauagcaaucccu

SEQ ID NO: 2557 - RNA, 19 nt, Artificial Sequence
  Synthetic Oligonucleotide
aacaaaauagcaaucccuu

SEQ ID NO: 2558 - RNA, 19 nt, Artificial Sequence
  Synthetic Oligonucleotide
acaaaauagcaaucccuuu

SEQ ID NO: 2559 - RNA, 19 nt, Artificial Sequence
  Synthetic Oligonucleotide
caaaauagcaaucccuuuu

SEQ ID NO: 2560 - RNA, 19 nt, Artificial Sequence
  Synthetic Oligonucleotide
aaaauagcaaucccuuuua

SEQ ID NO: 2561 - RNA, 19 nt, Artificial Sequence
  Synthetic Oligonucleotide
uucauugcuuuugacuuuu

SEQ ID NO: 2562 - RNA, 19 nt, Artificial Sequence
  Synthetic Oligonucleotide
ucauugcuuuugacuuuuc

SEQ ID NO: 2563 - RNA, 19 nt, Artificial Sequence
  Synthetic Oligonucleotide
cauugcuuuugacuuuuca

SEQ ID NO: 2564 - RNA, 19 nt, Artificial Sequence
  Synthetic Oligonucleotide
auugcuuuugacuuuucaa

SEQ ID NO: 2565 - RNA, 19 nt, Artificial Sequence
  Synthetic Oligonucleotide
uugcuuuugacuuuucaau

SEQ ID NO: 2566 - RNA, 19 nt, Artificial Sequence
  Synthetic Oligonucleotide
ugcuuuugacuuuucaaug

SEQ ID NO: 2567 - RNA, 19 nt, Artificial Sequence
  Synthetic Oligonucleotide
gcuuuugacuuuucaaugg

SEQ ID NO: 2568 - RNA, 19 nt, Artificial Sequence
  Synthetic Oligonucleotide
cuuuugacuuuucaauggg

SEQ ID NO: 2569 - RNA, 19 nt, Artificial Sequence
  Synthetic Oligonucleotide
uuuugacuuuucaaugggu

SEQ ID NO: 2570 - RNA, 19 nt, Artificial Sequence
  Synthetic Oligonucleotide
uuugacuuuucaaugggug

SEQ ID NO: 2571 - RNA, 19 nt, Artificial Sequence
  Synthetic Oligonucleotide
uugacuuuucaaugggugu

SEQ ID NO: 2572 - RNA, 19 nt, Artificial Sequence
  Synthetic Oligonucleotide
ugacuuuucaauggguguc

SEQ ID NO: 2573 - RNA, 19 nt, Artificial Sequence
  Synthetic Oligonucleotide
gacuuuucaaugggugucc

SEQ ID NO: 2574 - RNA, 19 nt, Artificial Sequence
  Synthetic Oligonucleotide
acuuuucaauggguguccu

SEQ ID NO: 2575 - RNA, 19 nt, Artificial Sequence
  Synthetic Oligonucleotide
cuuuucaauggguguccua

SEQ ID NO: 2576 - RNA, 19 nt, Artificial Sequence
  Synthetic Oligonucleotide
uuuucaauggguguccuag

SEQ ID NO: 2577 - RNA, 19 nt, Artificial Sequence
  Synthetic Oligonucleotide
uuucaauggguguccuagg

SEQ ID NO: 2578 - RNA, 19 nt, Artificial Sequence
  Synthetic Oligonucleotide
uucaauggguguccuagga

SEQ ID NO: 2579 - RNA, 19 nt, Artificial Sequence
  Synthetic Oligonucleotide
ucaauggguguccuaggaa

SEQ ID NO: 2580 - RNA, 19 nt, Artificial Sequence
  Synthetic Oligonucleotide
caauggguguccuaggaac

SEQ ID NO: 2581 - RNA, 19 nt, Artificial Sequence
  Synthetic Oligonucleotide
aauggguguccuaggaacc

SEQ ID NO: 2582 - RNA, 19 nt, Artificial Sequence
  Synthetic Oligonucleotide
auggguguccuaggaaccu

SEQ ID NO: 2583 - RNA, 19 nt, Artificial Sequence
  Synthetic Oligonucleotide
uggguguccuaggaaccuu

SEQ ID NO: 2584 - RNA, 19 nt, Artificial Sequence
  Synthetic Oligonucleotide
aaauggacuuucauccugg

SEQ ID NO: 2585 - RNA, 19 nt, Artificial Sequence
  Synthetic Oligonucleotide
aauggacuuucauccugga

SEQ ID NO: 2586 - RNA, 19 nt, Artificial Sequence
  Synthetic Oligonucleotide
auggacuuucauccuggaa

SEQ ID NO: 2587 - RNA, 19 nt, Artificial Sequence
  Synthetic Oligonucleotide
uggacuuucauccuggaaa

SEQ ID NO: 2588 - RNA, 19 nt, Artificial Sequence
  Synthetic Oligonucleotide
ggacuuucauccuggaaau

SEQ ID NO: 2589 - RNA, 19 nt, Artificial Sequence
  Synthetic Oligonucleotide
gacuuucauccuggaaaua

SEQ ID NO: 2590 - RNA, 19 nt, Artificial Sequence
  Synthetic Oligonucleotide
acuuucauccuggaaauau

SEQ ID NO: 2591 - RNA, 19 nt, Artificial Sequence
  Synthetic Oligonucleotide
cuuucauccuggaaauaua

SEQ ID NO: 2592 - RNA, 19 nt, Artificial Sequence
  Synthetic Oligonucleotide
uuucauccuggaaauauau

SEQ ID NO: 2593 - RNA, 19 nt, Artificial Sequence
  Synthetic Oligonucleotide
uucauccuggaaauauauu

SEQ ID NO: 2594 - RNA, 19 nt, Artificial Sequence
  Synthetic Oligonucleotide
ucauccuggaaauauauua

SEQ ID NO: 2595 - RNA, 19 nt, Artificial Sequence
  Synthetic Oligonucleotide
cauccuggaaauauauuaa

SEQ ID NO: 2596 - RNA, 19 nt, Artificial Sequence
  Synthetic Oligonucleotide
auccuggaaauauauuaac

SEQ ID NO: 2597 - RNA, 19 nt, Artificial Sequence
  Synthetic Oligonucleotide
uccuggaaauauauuaacu

SEQ ID NO: 2598 - RNA, 19 nt, Artificial Sequence
  Synthetic Oligonucleotide
ccuggaaauauauuaacug

SEQ ID NO: 2599 - RNA, 19 nt, Artificial Sequence
  Synthetic Oligonucleotide
cuggaaauauauuaacugu

SEQ ID NO: 2600 - RNA, 19 nt, Artificial Sequence
  Synthetic Oligonucleotide
uggaaauauauuaacuguu

SEQ ID NO: 2601 - RNA, 19 nt, Artificial Sequence
  Synthetic Oligonucleotide
ggaaauauauuaacuguua

SEQ ID NO: 2602 - RNA, 19 nt, Artificial Sequence
  Synthetic Oligonucleotide
gaaauauauuaacuguuaa

SEQ ID NO: 2603 - RNA, 19 nt, Artificial Sequence
  Synthetic Oligonucleotide
aaauauauuaacuguuaaa

SEQ ID NO: 2604 - RNA, 19 nt, Artificial Sequence
  Synthetic Oligonucleotide
aauauauuaacuguuaaaa

SEQ ID NO: 2605 - RNA, 19 nt, Artificial Sequence
  Synthetic Oligonucleotide
auauauuaacuguuaaaaa

SEQ ID NO: 2606 - RNA, 19 nt, Artificial Sequence
  Synthetic Oligonucleotide
uauauuaacuguuaaaaag

SEQ ID NO: 2607 - RNA, 19 nt, Artificial Sequence
  Synthetic Oligonucleotide
auauuaacuguuaaaaaga

SEQ ID NO: 2608 - RNA, 19 nt, Artificial Sequence
  Synthetic Oligonucleotide
uauuaacuguuaaaaagaa

SEQ ID NO: 2609 - RNA, 19 nt, Artificial Sequence
  Synthetic Oligonucleotide
auuaacuguuaaaaagaaa

SEQ ID NO: 2610 - RNA, 19 nt, Artificial Sequence
  Synthetic Oligonucleotide
uuaacuguuaaaaagaaaa

SEQ ID NO: 2611 - RNA, 19 nt, Artificial Sequence
  Synthetic Oligonucleotide
uaacuguuaaaaagaaaac

SEQ ID NO: 2612 - RNA, 19 nt, Artificial Sequence
  Synthetic Oligonucleotide
aacuguuaaaaagaaaaca

SEQ ID NO: 2613 - RNA, 19 nt, Artificial Sequence
  Synthetic Oligonucleotide
acuguuaaaaagaaaacau

SEQ ID NO: 2614 - RNA, 19 nt, Artificial Sequence
  Synthetic Oligonucleotide
cuguuaaaaagaaaacauu

SEQ ID NO: 2615 - RNA, 19 nt, Artificial Sequence
  Synthetic Oligonucleotide
uguuaaaaagaaaacauug

SEQ ID NO: 2616 - RNA, 19 nt, Artificial Sequence
  Synthetic Oligonucleotide
guuaaaaagaaaacauuga

SEQ ID NO: 2617 - RNA, 19 nt, Artificial Sequence
  Synthetic Oligonucleotide
uuaaaaagaaaacauugaa

SEQ ID NO: 2618 - RNA, 19 nt, Artificial Sequence
  Synthetic Oligonucleotide
caacgucauccccuggcag

SEQ ID NO: 2619 - RNA, 19 nt, Artificial Sequence
  Synthetic Oligonucleotide
aacgucauccccuggcagg

SEQ ID NO: 2620 - RNA, 19 nt, Artificial Sequence
  Synthetic Oligonucleotide
acgucauccccuggcaggc

SEQ ID NO: 2621 - RNA, 19 nt, Artificial Sequence
  Synthetic Oligonucleotide
cgucauccccuggcaggcu

SEQ ID NO: 2622 - RNA, 19 nt, Artificial Sequence
  Synthetic Oligonucleotide
gucauccccuggcaggcua

SEQ ID NO: 2623 - RNA, 19 nt, Artificial Sequence
  Synthetic Oligonucleotide
ucauccccuggcaggcuaa

SEQ ID NO: 2624 - RNA, 19 nt, Artificial Sequence
  Synthetic Oligonucleotide
cauccccuggcaggcuaaa

SEQ ID NO: 2625 - RNA, 19 nt, Artificial Sequence
  Synthetic Oligonucleotide
auccccuggcaggcuaaag

SEQ ID NO: 2626 - RNA, 19 nt, Artificial Sequence
  Synthetic Oligonucleotide
uccccuggcaggcuaaagu

SEQ ID NO: 2627 - RNA, 19 nt, Artificial Sequence
  Synthetic Oligonucleotide
ccccuggcaggcuaaagug

SEQ ID NO: 2628 - RNA, 19 nt, Artificial Sequence
  Synthetic Oligonucleotide
cccuggcaggcuaaagugc

SEQ ID NO: 2629 - RNA, 19 nt, Artificial Sequence
  Synthetic Oligonucleotide
ccuggcaggcuaaagugcu

SEQ ID NO: 2630 - RNA, 19 nt, Artificial Sequence
  Synthetic Oligonucleotide
cuggcaggcuaaagugcug

SEQ ID NO: 2631 - RNA, 19 nt, Artificial Sequence
  Synthetic Oligonucleotide
guagcaaacacuaagguga

SEQ ID NO: 2632 - RNA, 19 nt, Artificial Sequence
  Synthetic Oligonucleotide
uagcaaacacuaaggugaa

SEQ ID NO: 2633 - RNA, 19 nt, Artificial Sequence
  Synthetic Oligonucleotide
agcaaacacuaaggugaaa

SEQ ID NO: 2634 - RNA, 19 nt, Artificial Sequence
  Synthetic Oligonucleotide
gcaaacacuaaggugaaaa

SEQ ID NO: 2635 - RNA, 19 nt, Artificial Sequence
  Synthetic Oligonucleotide
aaacacuaaggugaaaaga

SEQ ID NO: 2636 - RNA, 19 nt, Artificial Sequence
  Synthetic Oligonucleotide
aacacuaaggugaaaagau

SEQ ID NO: 2637 - RNA, 19 nt, Artificial Sequence
  Synthetic Oligonucleotide
cuaaggugaaaagauaaug

SEQ ID NO: 2638 - RNA, 19 nt, Artificial Sequence
  Synthetic Oligonucleotide
uaaggugaaaagauaauga

SEQ ID NO: 2639 - RNA, 19 nt, Artificial Sequence
  Synthetic Oligonucleotide
aaggugaaaagauaaugau

SEQ ID NO: 2640 - RNA, 19 nt, Artificial Sequence
  Synthetic Oligonucleotide
aggugaaaagauaaugauc

SEQ ID NO: 2641 - RNA, 19 nt, Artificial Sequence
  Synthetic Oligonucleotide
ggugaaaagauaaugaucu

SEQ ID NO: 2642 - RNA, 19 nt, Artificial Sequence
  Synthetic Oligonucleotide
gugaaaagauaaugaucuc

SEQ ID NO: 2643 - RNA, 19 nt, Artificial Sequence
  Synthetic Oligonucleotide
ugaaaagauaaugaucuca

SEQ ID NO: 2644 - RNA, 19 nt, Artificial Sequence
  Synthetic Oligonucleotide
gaaaagauaaugaucucau

SEQ ID NO: 2645 - RNA, 19 nt, Artificial Sequence
  Synthetic Oligonucleotide
aaaagauaaugaucucauu

SEQ ID NO: 2646 - RNA, 19 nt, Artificial Sequence
  Synthetic Oligonucleotide
aaagauaaugaucucauug

SEQ ID NO: 2647 - RNA, 19 nt, Artificial Sequence
  Synthetic Oligonucleotide
aagauaaugaucucauugu

SEQ ID NO: 2648 - RNA, 19 nt, Artificial Sequence
  Synthetic Oligonucleotide
agauaaugaucucauuguu

SEQ ID NO: 2649 - RNA, 19 nt, Artificial Sequence
  Synthetic Oligonucleotide
gauaaugaucucauuguuu

SEQ ID NO: 2650 - RNA, 19 nt, Artificial Sequence
  Synthetic Oligonucleotide
auaaugaucucauuguuua

SEQ ID NO: 2651 - RNA, 19 nt, Artificial Sequence
  Synthetic Oligonucleotide
uaaugaucucauuguuuau

SEQ ID NO: 2652 - RNA, 19 nt, Artificial Sequence
  Synthetic Oligonucleotide
aaugaucucauuguuuauu

SEQ ID NO: 2653 - RNA, 19 nt, Artificial Sequence
  Synthetic Oligonucleotide
augaucucauuguuuauua

SEQ ID NO: 2654 - RNA, 19 nt, Artificial Sequence
  Synthetic Oligonucleotide
ugaucucauuguuuauuaa

SEQ ID NO: 2655 - RNA, 19 nt, Artificial Sequence
  Synthetic Oligonucleotide
gaucucauuguuuauuaac

SEQ ID NO: 2656 - RNA, 19 nt, Artificial Sequence
  Synthetic Oligonucleotide
aucucauuguuuauuaacc

SEQ ID NO: 2657 - RNA, 19 nt, Artificial Sequence
  Synthetic Oligonucleotide
ucucauuguuuauuaaccu

SEQ ID NO: 2658 - RNA, 19 nt, Artificial Sequence
  Synthetic Oligonucleotide
cucauuguuuauuaaccug

SEQ ID NO: 2659 - RNA, 19 nt, Artificial Sequence
  Synthetic Oligonucleotide
ucauuguuuauuaaccugu

SEQ ID NO: 2660 - RNA, 19 nt, Artificial Sequence
  Synthetic Oligonucleotide
cauuguuuauuaaccugua

SEQ ID NO: 2661 - RNA, 19 nt, Artificial Sequence
  Synthetic Oligonucleotide
auuguuuauuaaccuguau

SEQ ID NO: 2662 - RNA, 19 nt, Artificial Sequence
  Synthetic Oligonucleotide
guuuauuaaccuguauucu

SEQ ID NO: 2663 - RNA, 19 nt, Artificial Sequence
  Synthetic Oligonucleotide
uuuauuaaccuguauucug

SEQ ID NO: 2664 - RNA, 19 nt, Artificial Sequence
  Synthetic Oligonucleotide
auuaaccuguauucuguuu

SEQ ID NO: 2665 - RNA, 19 nt, Artificial Sequence
  Synthetic Oligonucleotide
uuaaccuguauucuguuua

SEQ ID NO: 2666 - RNA, 19 nt, Artificial Sequence
  Synthetic Oligonucleotide
uuaaaacagugguucuuaa

SEQ ID NO: 2667 - RNA, 19 nt, Artificial Sequence
  Synthetic Oligonucleotide
uaaaacagugguucuuaaa

SEQ ID NO: 2668 - RNA, 19 nt, Artificial Sequence
  Synthetic Oligonucleotide
aaaacagugguucuuaaau

SEQ ID NO: 2669 - RNA, 19 nt, Artificial Sequence
  Synthetic Oligonucleotide
aaacagugguucuuaaauu

SEQ ID NO: 2670 - RNA, 19 nt, Artificial Sequence
  Synthetic Oligonucleotide
aacagugguucuuaaauug

SEQ ID NO: 2671 - RNA, 19 nt, Artificial Sequence
  Synthetic Oligonucleotide
acagugguucuuaaauugu

SEQ ID NO: 2672 - RNA, 19 nt, Artificial Sequence
  Synthetic Oligonucleotide
cagugguucuuaaauugua

SEQ ID NO: 2673 - RNA, 19 nt, Artificial Sequence
  Synthetic Oligonucleotide
guucuuaaauuguaagcuc

SEQ ID NO: 2674 - RNA, 19 nt, Artificial Sequence
  Synthetic Oligonucleotide
cuuaaauuguaagcucagg

SEQ ID NO: 2675 - RNA, 19 nt, Artificial Sequence
  Synthetic Oligonucleotide
uuaaauuguaagcucaggu

SEQ ID NO: 2676 - RNA, 19 nt, Artificial Sequence
  Synthetic Oligonucleotide
aaauuguaagcucagguuc

SEQ ID NO: 2677 - RNA, 19 nt, Artificial Sequence
  Synthetic Oligonucleotide
aauuguaagcucagguuca

SEQ ID NO: 2678 - RNA, 19 nt, Artificial Sequence
  Synthetic Oligonucleotide
auuguaagcucagguucaa

SEQ ID NO: 2679 - RNA, 19 nt, Artificial Sequence
  Synthetic Oligonucleotide
ggugauacuucuuugaaug

SEQ ID NO: 2680 - RNA, 19 nt, Artificial Sequence
  Synthetic Oligonucleotide
aucacaucuuuagugucug

SEQ ID NO: 2681 - RNA, 19 nt, Artificial Sequence
  Synthetic Oligonucleotide
uagugucugaauauaucca

SEQ ID NO: 2682 - RNA, 19 nt, Artificial Sequence
  Synthetic Oligonucleotide
agugucugaauauauccaa

SEQ ID NO: 2683 - RNA, 19 nt, Artificial Sequence
  Synthetic Oligonucleotide
gugucugaauauauccaaa

SEQ ID NO: 2684 - RNA, 19 nt, Artificial Sequence
  Synthetic Oligonucleotide
gucugaauauauccaaaug

SEQ ID NO: 2685 - RNA, 19 nt, Artificial Sequence
  Synthetic Oligonucleotide
ucugaauauauccaaaugu

SEQ ID NO: 2686 - RNA, 19 nt, Artificial Sequence
  Synthetic Oligonucleotide
cugaauauauccaaauguu

SEQ ID NO: 2687 - RNA, 19 nt, Artificial Sequence
  Synthetic Oligonucleotide
ugaauauauccaaauguuu

SEQ ID NO: 2688 - RNA, 19 nt, Artificial Sequence
  Synthetic Oligonucleotide
gaauauauccaaauguuuu

SEQ ID NO: 2689 - RNA, 19 nt, Artificial Sequence
  Synthetic Oligonucleotide
cggcuaauuuguaucaaug

SEQ ID NO: 2690 - RNA, 19 nt, Artificial Sequence
  Synthetic Oligonucleotide
ggcuaauuuguaucaauga

SEQ ID NO: 2691 - RNA, 19 nt, Artificial Sequence
  Synthetic Oligonucleotide
gcuaauuuguaucaaugau

SEQ ID NO: 2692 - RNA, 19 nt, Artificial Sequence
  Synthetic Oligonucleotide
cuaauuuguaucaaugauu

SEQ ID NO: 2693 - RNA, 19 nt, Artificial Sequence
  Synthetic Oligonucleotide
uaauuuguaucaaugauua

SEQ ID NO: 2694 - RNA, 19 nt, Artificial Sequence
  Synthetic Oligonucleotide
aauuuguaucaaugauuau

SEQ ID NO: 2695 - RNA, 19 nt, Artificial Sequence
  Synthetic Oligonucleotide
auuuguaucaaugauuaug

SEQ ID NO: 2696 - RNA, 19 nt, Artificial Sequence
  Synthetic Oligonucleotide
uuuguaucaaugauuauga

SEQ ID NO: 2697 - RNA, 19 nt, Artificial Sequence
  Synthetic Oligonucleotide
uuguaucaaugauuaugaa

SEQ ID NO: 2698 - RNA, 19 nt, Artificial Sequence
  Synthetic Oligonucleotide
uguaucaaugauuaugaac

SEQ ID NO: 2699 - RNA, 19 nt, Artificial Sequence
  Synthetic Oligonucleotide
uaucaaugauuaugaacaa

SEQ ID NO: 2700 - RNA, 19 nt, Artificial Sequence
  Synthetic Oligonucleotide
aucaaugauuaugaacaac

SEQ ID NO: 2701 - RNA, 19 nt, Artificial Sequence
  Synthetic Oligonucleotide
ucaaugauuaugaacaaca

SEQ ID NO: 2702 - RNA, 19 nt, Artificial Sequence
  Synthetic Oligonucleotide
caaugauuaugaacaacau

SEQ ID NO: 2703 - RNA, 19 nt, Artificial Sequence
  Synthetic Oligonucleotide
aaugauuaugaacaacaug

SEQ ID NO: 2704 - RNA, 19 nt, Artificial Sequence
  Synthetic Oligonucleotide
augauuaugaacaacaugc

SEQ ID NO: 2705 - RNA, 19 nt, Artificial Sequence
  Synthetic Oligonucleotide
ugauuaugaacaacaugcu

SEQ ID NO: 2706 - RNA, 19 nt, Artificial Sequence
  Synthetic Oligonucleotide
gauuaugaacaacaugcua

SEQ ID NO: 2707 - RNA, 19 nt, Artificial Sequence
  Synthetic Oligonucleotide
uaugaacaacaugcuaaau

SEQ ID NO: 2708 - RNA, 19 nt, Artificial Sequence
  Synthetic Oligonucleotide
ugaacaacaugcuaaauca

SEQ ID NO: 2709 - RNA, 19 nt, Artificial Sequence
  Synthetic Oligonucleotide
gaacaacaugcuaaaucag

SEQ ID NO: 2710 - RNA, 19 nt, Artificial Sequence
  Synthetic Oligonucleotide
caacaugcuaaaucaguac

SEQ ID NO: 2711 - RNA, 19 nt, Artificial Sequence
  Synthetic Oligonucleotide
aaaucaguacuuccaaagu

SEQ ID NO: 2712 - RNA, 19 nt, Artificial Sequence
  Synthetic Oligonucleotide
aaucaguacuuccaaaguc

SEQ ID NO: 2713 - RNA, 19 nt, Artificial Sequence
  Synthetic Oligonucleotide
ucaguacuuccaaagucua

SEQ ID NO: 2714 - RNA, 19 nt, Artificial Sequence
  Synthetic Oligonucleotide
caguacuuccaaagucuau

SEQ ID NO: 2715 - RNA, 19 nt, Artificial Sequence
  Synthetic Oligonucleotide
aguacuuccaaagucuaua

SEQ ID NO: 2716 - RNA, 19 nt, Artificial Sequence
  Synthetic Oligonucleotide
acuuccaaagucuauauau

SEQ ID NO: 2717 - RNA, 19 nt, Artificial Sequence
  Synthetic Oligonucleotide
uccaaagucuauauaugac

SEQ ID NO: 2718 - RNA, 19 nt, Artificial Sequence
  Synthetic Oligonucleotide
ccaaagucuauauaugacu

SEQ ID NO: 2719 - RNA, 19 nt, Artificial Sequence
  Synthetic Oligonucleotide
aaagucuauauaugacuau

SEQ ID NO: 2720 - RNA, 19 nt, Artificial Sequence
  Synthetic Oligonucleotide
auaugacuauuacaggucu

SEQ ID NO: 2721 - RNA, 19 nt, Artificial Sequence
  Synthetic Oligonucleotide
uaugacuauuacaggucug

SEQ ID NO: 2722 - RNA, 19 nt, Artificial Sequence
  Synthetic Oligonucleotide
augacuauuacaggucugg

SEQ ID NO: 2723 - RNA, 19 nt, Artificial Sequence
  Synthetic Oligonucleotide
ugacuauuacaggucuggg

SEQ ID NO: 2724 - RNA, 19 nt, Artificial Sequence
  Synthetic Oligonucleotide
gacuauuacaggucugggg

SEQ ID NO: 2725 - RNA, 19 nt, Artificial Sequence
  Synthetic Oligonucleotide
acuauuacaggucuggggc

SEQ ID NO: 2726 - RNA, 19 nt, Artificial Sequence
  Synthetic Oligonucleotide
cuauuacaggucuggggca

SEQ ID NO: 2727 - RNA, 19 nt, Artificial Sequence
  Synthetic Oligonucleotide
uauuacaggucuggggcaa

SEQ ID NO: 2728 - RNA, 19 nt, Artificial Sequence
  Synthetic Oligonucleotide
auuacaggucuggggcaaa

SEQ ID NO: 2729 - RNA, 19 nt, Artificial Sequence
  Synthetic Oligonucleotide
uuacaggucuggggcaaau

SEQ ID NO: 2730 - RNA, 19 nt, Artificial Sequence
  Synthetic Oligonucleotide
uacaggucuggggcaaaug

SEQ ID NO: 2731 - RNA, 19 nt, Artificial Sequence
  Synthetic Oligonucleotide
acaggucuggggcaaauga

SEQ ID NO: 2732 - RNA, 19 nt, Artificial Sequence
  Synthetic Oligonucleotide
cggaauguugcugaaacag

SEQ ID NO: 2733 - RNA, 19 nt, Artificial Sequence
  Synthetic Oligonucleotide
gacuucuguuuuaggacag

SEQ ID NO: 2734 - RNA, 19 nt, Artificial Sequence
  Synthetic Oligonucleotide
acuucuguuuuaggacaga

SEQ ID NO: 2735 - RNA, 19 nt, Artificial Sequence
  Synthetic Oligonucleotide
cuacaaggccauauuugug

SEQ ID NO: 2736 - RNA, 19 nt, Artificial Sequence
  Synthetic Oligonucleotide
uacaaggccauauuuguga

SEQ ID NO: 2737 - RNA, 19 nt, Artificial Sequence
  Synthetic Oligonucleotide
gccacaacucaggaugaaa

SEQ ID NO: 2738 - RNA, 19 nt, Artificial Sequence
  Synthetic Oligonucleotide
ccacaacucaggaugaaaa

SEQ ID NO: 2739 - RNA, 19 nt, Artificial Sequence
  Synthetic Oligonucleotide
cacaacucaggaugaaaaa

SEQ ID NO: 2740 - RNA, 19 nt, Artificial Sequence
  Synthetic Oligonucleotide
acaacucaggaugaaaaau

SEQ ID NO: 2741 - RNA, 19 nt, Artificial Sequence
  Synthetic Oligonucleotide
caacucaggaugaaaaauu

SEQ ID NO: 2742 - RNA, 19 nt, Artificial Sequence
  Synthetic Oligonucleotide
acucaggaugaaaaauuuu

SEQ ID NO: 2743 - RNA, 19 nt, Artificial Sequence
  Synthetic Oligonucleotide
cucaggaugaaaaauuuug

SEQ ID NO: 2744 - RNA, 19 nt, Artificial Sequence
  Synthetic Oligonucleotide
ucaggaugaaaaauuuuga

SEQ ID NO: 2745 - RNA, 19 nt, Artificial Sequence
  Synthetic Oligonucleotide
caggaugaaaaauuuugaa

SEQ ID NO: 2746 - RNA, 19 nt, Artificial Sequence
  Synthetic Oligonucleotide
ggaugaaaaauuuugaaac

SEQ ID NO: 2747 - RNA, 19 nt, Artificial Sequence
  Synthetic Oligonucleotide
gaugaaaaauuuugaaacc

SEQ ID NO: 2748 - RNA, 19 nt, Artificial Sequence
  Synthetic Oligonucleotide
augaaaaauuuugaaacca

SEQ ID NO: 2749 - RNA, 19 nt, Artificial Sequence
  Synthetic Oligonucleotide
ugaaaaauuuugaaaccag

SEQ ID NO: 2750 - RNA, 19 nt, Artificial Sequence
  Synthetic Oligonucleotide
gaaaaauuuugaaaccagu

SEQ ID NO: 2751 - RNA, 19 nt, Artificial Sequence
  Synthetic Oligonucleotide
aaaaauuuugaaaccagua

SEQ ID NO: 2752 - RNA, 19 nt, Artificial Sequence
  Synthetic Oligonucleotide
aaaauuuugaaaccaguac

SEQ ID NO: 2753 - RNA, 19 nt, Artificial Sequence
  Synthetic Oligonucleotide
aaauuuugaaaccaguacu

SEQ ID NO: 2754 - RNA, 19 nt, Artificial Sequence
  Synthetic Oligonucleotide
aauuuugaaaccaguacuu

SEQ ID NO: 2755 - RNA, 19 nt, Artificial Sequence
  Synthetic Oligonucleotide
auuuugaaaccaguacuuu

SEQ ID NO: 2756 - RNA, 19 nt, Artificial Sequence
  Synthetic Oligonucleotide
uuuugaaaccaguacuuua

SEQ ID NO: 2757 - RNA, 19 nt, Artificial Sequence
  Synthetic Oligonucleotide
uuugaaaccaguacuuuau

SEQ ID NO: 2758 - RNA, 19 nt, Artificial Sequence
  Synthetic Oligonucleotide
uugaaaccaguacuuuauc

SEQ ID NO: 2759 - RNA, 19 nt, Artificial Sequence
  Synthetic Oligonucleotide
ugaaaccaguacuuuauca

SEQ ID NO: 2760 - RNA, 19 nt, Artificial Sequence
  Synthetic Oligonucleotide
gaaaccaguacuuuaucau

SEQ ID NO: 2761 - RNA, 19 nt, Artificial Sequence
  Synthetic Oligonucleotide
aaaccaguacuuuaucauu

SEQ ID NO: 2762 - RNA, 19 nt, Artificial Sequence
  Synthetic Oligonucleotide
accaguacuuuaucauuuu

SEQ ID NO: 2763 - RNA, 19 nt, Artificial Sequence
  Synthetic Oligonucleotide
ccaguacuuuaucauuuuc

SEQ ID NO: 2764 - RNA, 19 nt, Artificial Sequence
  Synthetic Oligonucleotide
uaucauuuucuccugagga

SEQ ID NO: 2765 - RNA, 19 nt, Artificial Sequence
  Synthetic Oligonucleotide
aaauggcugagaagacuga

SEQ ID NO: 2766 - RNA, 19 nt, Artificial Sequence
  Synthetic Oligonucleotide
caaagggcauuuugagagg

SEQ ID NO: 2767 - RNA, 19 nt, Artificial Sequence
  Synthetic Oligonucleotide
aaagggcauuuugagaggu

SEQ ID NO: 2768 - RNA, 19 nt, Artificial Sequence
  Synthetic Oligonucleotide
aagggcauuuugagaggug

SEQ ID NO: 2769 - RNA, 19 nt, Artificial Sequence
  Synthetic Oligonucleotide
agggcauuuugagagguga

SEQ ID NO: 2770 - RNA, 19 nt, Artificial Sequence
  Synthetic Oligonucleotide
gggcauuuugagaggugau

SEQ ID NO: 2771 - RNA, 19 nt, Artificial Sequence
  Synthetic Oligonucleotide
ggcauuuugagaggugaug

SEQ ID NO: 2772 - RNA, 19 nt, Artificial Sequence
  Synthetic Oligonucleotide
gcauuuugagaggugauga

SEQ ID NO: 2773 - RNA, 19 nt, Artificial Sequence
  Synthetic Oligonucleotide
cauuuugagaggugaugau

SEQ ID NO: 2774 - RNA, 19 nt, Artificial Sequence
  Synthetic Oligonucleotide
auuuugagaggugaugaug

SEQ ID NO: 2775 - RNA, 19 nt, Artificial Sequence
  Synthetic Oligonucleotide
uuuugagaggugaugaugc

SEQ ID NO: 2776 - RNA, 19 nt, Artificial Sequence
  Synthetic Oligonucleotide
uuugagaggugaugaugcc

SEQ ID NO: 2777 - RNA, 19 nt, Artificial Sequence
  Synthetic Oligonucleotide
aaugggaucuuggugucga

SEQ ID NO: 2778 - RNA, 19 nt, Artificial Sequence
  Synthetic Oligonucleotide
augggaucuuggugucgaa

SEQ ID NO: 2779 - RNA, 19 nt, Artificial Sequence
  Synthetic Oligonucleotide
ugggaucuuggugucgaau

SEQ ID NO: 2780 - RNA, 19 nt, Artificial Sequence
  Synthetic Oligonucleotide
gggaucuuggugucgaauc

SEQ ID NO: 2781 - RNA, 19 nt, Artificial Sequence
  Synthetic Oligonucleotide
ggaucuuggugucgaauca

SEQ ID NO: 2782 - RNA, 19 nt, Artificial Sequence
  Synthetic Oligonucleotide
gaucuuggugucgaaucau

SEQ ID NO: 2783 - RNA, 19 nt, Artificial Sequence
  Synthetic Oligonucleotide
aucuuggugucgaaucaug

SEQ ID NO: 2784 - RNA, 19 nt, Artificial Sequence
  Synthetic Oligonucleotide
ucuuggugucgaaucaugg

SEQ ID NO: 2785 - RNA, 19 nt, Artificial Sequence
  Synthetic Oligonucleotide
cuuggugucgaaucauggg

SEQ ID NO: 2786 - RNA, 19 nt, Artificial Sequence
  Synthetic Oligonucleotide
uuggugucgaaucaugggg

SEQ ID NO: 2787 - RNA, 19 nt, Artificial Sequence
  Synthetic Oligonucleotide
gccacuauugauguucugc

SEQ ID NO: 2788 - RNA, 19 nt, Artificial Sequence
  Synthetic Oligonucleotide
acuauugauguucugccag

SEQ ID NO: 2789 - RNA, 19 nt, Artificial Sequence
  Synthetic Oligonucleotide
cuauugauguucugccaga

SEQ ID NO: 2790 - RNA, 19 nt, Artificial Sequence
  Synthetic Oligonucleotide
ggaggcuguggaagggaag

SEQ ID NO: 2791 - RNA, 19 nt, Artificial Sequence
  Synthetic Oligonucleotide
gaggcuguggaagggaagg

SEQ ID NO: 2792 - RNA, 19 nt, Artificial Sequence
  Synthetic Oligonucleotide
gggagaaagguguucaaga

SEQ ID NO: 2793 - RNA, 19 nt, Artificial Sequence
  Synthetic Oligonucleotide
ggagaaagguguucaagau

SEQ ID NO: 2794 - RNA, 19 nt, Artificial Sequence
  Synthetic Oligonucleotide
gagaaagguguucaagaug

SEQ ID NO: 2795 - RNA, 19 nt, Artificial Sequence
  Synthetic Oligonucleotide
agaaagguguucaagaugu

SEQ ID NO: 2796 - RNA, 19 nt, Artificial Sequence
  Synthetic Oligonucleotide
gaaagguguucaagauguc

SEQ ID NO: 2797 - RNA, 19 nt, Artificial Sequence
  Synthetic Oligonucleotide
aaagguguucaagaugucc

SEQ ID NO: 2798 - RNA, 19 nt, Artificial Sequence
  Synthetic Oligonucleotide
aagguguucaagauguccu

SEQ ID NO: 2799 - RNA, 19 nt, Artificial Sequence
  Synthetic Oligonucleotide
agguguucaagauguccuc

SEQ ID NO: 2800 - RNA, 19 nt, Artificial Sequence
  Synthetic Oligonucleotide
gguguucaagauguccucg

SEQ ID NO: 2801 - RNA, 19 nt, Artificial Sequence
  Synthetic Oligonucleotide
guguucaagauguccucga

SEQ ID NO: 2802 - RNA, 19 nt, Artificial Sequence
  Synthetic Oligonucleotide
uguucaagauguccucgag

SEQ ID NO: 2803 - RNA, 19 nt, Artificial Sequence
  Synthetic Oligonucleotide
guucaagauguccucgaga

SEQ ID NO: 2804 - RNA, 19 nt, Artificial Sequence
  Synthetic Oligonucleotide
uucaagauguccucgagau

SEQ ID NO: 2805 - RNA, 19 nt, Artificial Sequence
  Synthetic Oligonucleotide
uuggccauggcucugagug

SEQ ID NO: 2806 - RNA, 19 nt, Artificial Sequence
  Synthetic Oligonucleotide
uggccauggcucugagugg

SEQ ID NO: 2807 - RNA, 19 nt, Artificial Sequence
  Synthetic Oligonucleotide
ggccauggcucugaguggg

SEQ ID NO: 2808 - RNA, 19 nt, Artificial Sequence
  Synthetic Oligonucleotide
gccauggcucugagugggu

SEQ ID NO: 2809 - RNA, 19 nt, Artificial Sequence
  Synthetic Oligonucleotide
ccauggcucugagugggug

SEQ ID NO: 2810 - RNA, 19 nt, Artificial Sequence
  Synthetic Oligonucleotide
cauggcucugagugggugc

SEQ ID NO: 2811 - RNA, 19 nt, Artificial Sequence
  Synthetic Oligonucleotide
auggcucugagugggugcc

SEQ ID NO: 2812 - RNA, 19 nt, Artificial Sequence
  Synthetic Oligonucleotide
uggcucugagugggugcca

SEQ ID NO: 2813 - RNA, 19 nt, Artificial Sequence
  Synthetic Oligonucleotide
ggcucugagugggugccag

SEQ ID NO: 2814 - RNA, 19 nt, Artificial Sequence
  Synthetic Oligonucleotide
gcucugagugggugccaga

SEQ ID NO: 2815 - RNA, 19 nt, Artificial Sequence
  Synthetic Oligonucleotide
cucugagugggugccagaa

SEQ ID NO: 2816 - RNA, 19 nt, Artificial Sequence
  Synthetic Oligonucleotide
ucugagugggugccagaau

SEQ ID NO: 2817 - RNA, 19 nt, Artificial Sequence
  Synthetic Oligonucleotide
cugagugggugccagaaug

SEQ ID NO: 2818 - RNA, 19 nt, Artificial Sequence
  Synthetic Oligonucleotide
ugagugggugccagaaugu

SEQ ID NO: 2819 - RNA, 19 nt, Artificial Sequence
  Synthetic Oligonucleotide
gagugggugccagaaugug

SEQ ID NO: 2820 - RNA, 19 nt, Artificial Sequence
  Synthetic Oligonucleotide
agugggugccagaauguga

SEQ ID NO: 2821 - RNA, 19 nt, Artificial Sequence
  Synthetic Oligonucleotide
gugggugccagaaugugaa

SEQ ID NO: 2822 - RNA, 19 nt, Artificial Sequence
  Synthetic Oligonucleotide
ugggugccagaaugugaaa

SEQ ID NO: 2823 - RNA, 19 nt, Artificial Sequence
  Synthetic Oligonucleotide
gggugccagaaugugaaag

SEQ ID NO: 2824 - RNA, 19 nt, Artificial Sequence
  Synthetic Oligonucleotide
ggugccagaaugugaaagu

SEQ ID NO: 2825 - RNA, 19 nt, Artificial Sequence
  Synthetic Oligonucleotide
gugccagaaugugaaaguc

SEQ ID NO: 2826 - RNA, 19 nt, Artificial Sequence
  Synthetic Oligonucleotide
ugccagaaugugaaaguca

SEQ ID NO: 2827 - RNA, 19 nt, Artificial Sequence
  Synthetic Oligonucleotide
gccagaaugugaaagucau

SEQ ID NO: 2828 - RNA, 19 nt, Artificial Sequence
  Synthetic Oligonucleotide
ccagaaugugaaagucauc

SEQ ID NO: 2829 - RNA, 19 nt, Artificial Sequence
  Synthetic Oligonucleotide
cagaaugugaaagucaucg

SEQ ID NO: 2830 - RNA, 19 nt, Artificial Sequence
  Synthetic Oligonucleotide
agaaugugaaagucaucga

SEQ ID NO: 2831 - RNA, 19 nt, Artificial Sequence
  Synthetic Oligonucleotide
gaaugugaaagucaucgac

SEQ ID NO: 2832 - RNA, 19 nt, Artificial Sequence
  Synthetic Oligonucleotide
aaugugaaagucaucgaca

SEQ ID NO: 2833 - RNA, 19 nt, Artificial Sequence
  Synthetic Oligonucleotide
augugaaagucaucgacaa

SEQ ID NO: 2834 - RNA, 19 nt, Artificial Sequence
  Synthetic Oligonucleotide
ugugaaagucaucgacaag

SEQ ID NO: 2835 - RNA, 19 nt, Artificial Sequence
  Synthetic Oligonucleotide
gugaaagucaucgacaaga

SEQ ID NO: 2836 - RNA, 19 nt, Artificial Sequence
  Synthetic Oligonucleotide
ugaaagucaucgacaagac

SEQ ID NO: 2837 - RNA, 19 nt, Artificial Sequence
  Synthetic Oligonucleotide
gaaagucaucgacaagaca

SEQ ID NO: 2838 - RNA, 19 nt, Artificial Sequence
  Synthetic Oligonucleotide
aaagucaucgacaagacau

SEQ ID NO: 2839 - RNA, 19 nt, Artificial Sequence
  Synthetic Oligonucleotide
aagucaucgacaagacauu

SEQ ID NO: 2840 - RNA, 19 nt, Artificial Sequence
  Synthetic Oligonucleotide
agucaucgacaagacauug

SEQ ID NO: 2841 - RNA, 19 nt, Artificial Sequence
  Synthetic Oligonucleotide
gucaucgacaagacauugg

SEQ ID NO: 2842 - RNA, 19 nt, Artificial Sequence
  Synthetic Oligonucleotide
ucaucgacaagacauuggu

SEQ ID NO: 2843 - RNA, 19 nt, Artificial Sequence
  Synthetic Oligonucleotide
caucgacaagacauuggug

SEQ ID NO: 2844 - RNA, 19 nt, Artificial Sequence
  Synthetic Oligonucleotide
aucgacaagacauugguga

SEQ ID NO: 2845 - RNA, 19 nt, Artificial Sequence
  Synthetic Oligonucleotide
ucgacaagacauuggugag

SEQ ID NO: 2846 - RNA, 19 nt, Artificial Sequence
  Synthetic Oligonucleotide
cgacaagacauuggugagg

SEQ ID NO: 2847 - RNA, 19 nt, Artificial Sequence
  Synthetic Oligonucleotide
gacaagacauuggugagga

SEQ ID NO: 2848 - RNA, 19 nt, Artificial Sequence
  Synthetic Oligonucleotide
acaagacauuggugaggaa

SEQ ID NO: 2849 - RNA, 19 nt, Artificial Sequence
  Synthetic Oligonucleotide
caagacauuggugaggaaa

SEQ ID NO: 2850 - RNA, 19 nt, Artificial Sequence
  Synthetic Oligonucleotide
aagacauuggugaggaaaa

SEQ ID NO: 2851 - RNA, 19 nt, Artificial Sequence
  Synthetic Oligonucleotide
agacauuggugaggaaaaa

SEQ ID NO: 2852 - RNA, 19 nt, Artificial Sequence
  Synthetic Oligonucleotide
gacauuggugaggaaaaau

SEQ ID NO: 2853 - RNA, 19 nt, Artificial Sequence
  Synthetic Oligonucleotide
acauuggugaggaaaaauc

SEQ ID NO: 2854 - RNA, 19 nt, Artificial Sequence
  Synthetic Oligonucleotide
cauuggugaggaaaaaucc

SEQ ID NO: 2855 - RNA, 19 nt, Artificial Sequence
  Synthetic Oligonucleotide
auuggugaggaaaaauccu

SEQ ID NO: 2856 - RNA, 19 nt, Artificial Sequence
  Synthetic Oligonucleotide
uuggugaggaaaaauccuu

SEQ ID NO: 2857 - RNA, 19 nt, Artificial Sequence
  Synthetic Oligonucleotide
uggugaggaaaaauccuuu

SEQ ID NO: 2858 - RNA, 19 nt, Artificial Sequence
  Synthetic Oligonucleotide
ggugaggaaaaauccuuug

SEQ ID NO: 2859 - RNA, 19 nt, Artificial Sequence
  Synthetic Oligonucleotide
gugaggaaaaauccuuugg

SEQ ID NO: 2860 - RNA, 19 nt, Artificial Sequence
  Synthetic Oligonucleotide
cguuuccaagaucugacag

SEQ ID NO: 2861 - RNA, 19 nt, Artificial Sequence
  Synthetic Oligonucleotide
guuuccaagaucugacagu

SEQ ID NO: 2862 - RNA, 19 nt, Artificial Sequence
  Synthetic Oligonucleotide
uuuccaagaucugacagug

SEQ ID NO: 2863 - RNA, 19 nt, Artificial Sequence
  Synthetic Oligonucleotide
uuccaagaucugacagugc

SEQ ID NO: 2864 - RNA, 19 nt, Artificial Sequence
  Synthetic Oligonucleotide
uccaagaucugacagugca

SEQ ID NO: 2865 - RNA, 19 nt, Artificial Sequence
  Synthetic Oligonucleotide
ccaagaucugacagugcac

SEQ ID NO: 2866 - RNA, 19 nt, Artificial Sequence
  Synthetic Oligonucleotide
caagaucugacagugcaca

SEQ ID NO: 2867 - RNA, 19 nt, Artificial Sequence
  Synthetic Oligonucleotide
aagaucugacagugcacaa

SEQ ID NO: 2868 - RNA, 19 nt, Artificial Sequence
  Synthetic Oligonucleotide
agaucugacagugcacaau

SEQ ID NO: 2869 - RNA, 19 nt, Artificial Sequence
  Synthetic Oligonucleotide
gaucugacagugcacaaua

SEQ ID NO: 2870 - RNA, 19 nt, Artificial Sequence
  Synthetic Oligonucleotide
aucugacagugcacaauau

SEQ ID NO: 2871 - RNA, 19 nt, Artificial Sequence
  Synthetic Oligonucleotide
ucugacagugcacaauauu

SEQ ID NO: 2872 - RNA, 19 nt, Artificial Sequence
  Synthetic Oligonucleotide
cugacagugcacaauauuu

SEQ ID NO: 2873 - RNA, 19 nt, Artificial Sequence
  Synthetic Oligonucleotide
ugacagugcacaauauuuu

SEQ ID NO: 2874 - RNA, 19 nt, Artificial Sequence
  Synthetic Oligonucleotide
gacagugcacaauauuuuc

SEQ ID NO: 2875 - RNA, 19 nt, Artificial Sequence
  Synthetic Oligonucleotide
acagugcacaauauuuucc

SEQ ID NO: 2876 - RNA, 19 nt, Artificial Sequence
  Synthetic Oligonucleotide
cagugcacaauauuuuccc

SEQ ID NO: 2877 - RNA, 19 nt, Artificial Sequence
  Synthetic Oligonucleotide
agugcacaauauuuuccca

SEQ ID NO: 2878 - RNA, 19 nt, Artificial Sequence
  Synthetic Oligonucleotide
gugcacaauauuuucccau

SEQ ID NO: 2879 - RNA, 19 nt, Artificial Sequence
  Synthetic Oligonucleotide
ugcacaauauuuucccauc

SEQ ID NO: 2880 - RNA, 19 nt, Artificial Sequence
  Synthetic Oligonucleotide
gcacaauauuuucccaucu

SEQ ID NO: 2881 - RNA, 19 nt, Artificial Sequence
  Synthetic Oligonucleotide
cacaauauuuucccaucug

SEQ ID NO: 2882 - RNA, 19 nt, Artificial Sequence
  Synthetic Oligonucleotide
acaauauuuucccaucugu

SEQ ID NO: 2883 - RNA, 19 nt, Artificial Sequence
  Synthetic Oligonucleotide
caauauuuucccaucugua

SEQ ID NO: 2884 - RNA, 19 nt, Artificial Sequence
  Synthetic Oligonucleotide
aauauuuucccaucuguau

SEQ ID NO: 2885 - RNA, 19 nt, Artificial Sequence
  Synthetic Oligonucleotide
auauuuucccaucuguauu

SEQ ID NO: 2886 - RNA, 19 nt, Artificial Sequence
  Synthetic Oligonucleotide
uauuuucccaucuguauua

SEQ ID NO: 2887 - RNA, 19 nt, Artificial Sequence
  Synthetic Oligonucleotide
uuuuuucagcauguauuac

SEQ ID NO: 2888 - RNA, 19 nt, Artificial Sequence
  Synthetic Oligonucleotide
uuuuucagcauguauuacu

SEQ ID NO: 2889 - RNA, 19 nt, Artificial Sequence
  Synthetic Oligonucleotide
uuuucagcauguauuacuu

SEQ ID NO: 2890 - RNA, 19 nt, Artificial Sequence
  Synthetic Oligonucleotide
uuucagcauguauuacuug

SEQ ID NO: 2891 - RNA, 19 nt, Artificial Sequence
  Synthetic Oligonucleotide
uucagcauguauuacuuga

SEQ ID NO: 2892 - RNA, 19 nt, Artificial Sequence
  Synthetic Oligonucleotide
ucagcauguauuacuugac

SEQ ID NO: 2893 - RNA, 19 nt, Artificial Sequence
  Synthetic Oligonucleotide
cagcauguauuacuugaca

SEQ ID NO: 2894 - RNA, 19 nt, Artificial Sequence
  Synthetic Oligonucleotide
agcauguauuacuugacaa

SEQ ID NO: 2895 - RNA, 19 nt, Artificial Sequence
  Synthetic Oligonucleotide
gcauguauuacuugacaaa

SEQ ID NO: 2896 - RNA, 19 nt, Artificial Sequence
  Synthetic Oligonucleotide
guauuacuugacaaagaga

SEQ ID NO: 2897 - RNA, 19 nt, Artificial Sequence
  Synthetic Oligonucleotide
uauuacuugacaaagagac

SEQ ID NO: 2898 - RNA, 19 nt, Artificial Sequence
  Synthetic Oligonucleotide
auuacuugacaaagagaca

SEQ ID NO: 2899 - RNA, 19 nt, Artificial Sequence
  Synthetic Oligonucleotide
uuacuugacaaagagacac

SEQ ID NO: 2900 - RNA, 19 nt, Artificial Sequence
  Synthetic Oligonucleotide
uacuugacaaagagacacu

SEQ ID NO: 2901 - RNA, 19 nt, Artificial Sequence
  Synthetic Oligonucleotide
acuugacaaagagacacug

SEQ ID NO: 2902 - RNA, 19 nt, Artificial Sequence
  Synthetic Oligonucleotide
cuugacaaagagacacugu

SEQ ID NO: 2903 - RNA, 19 nt, Artificial Sequence
  Synthetic Oligonucleotide
uugacaaagagacacugug

SEQ ID NO: 2904 - RNA, 19 nt, Artificial Sequence
  Synthetic Oligonucleotide
ugacaaagagacacugugc

SEQ ID NO: 2905 - RNA, 19 nt, Artificial Sequence
  Synthetic Oligonucleotide
gacaaagagacacugugca

SEQ ID NO: 2906 - RNA, 19 nt, Artificial Sequence
  Synthetic Oligonucleotide
acaaagagacacugugcag

SEQ ID NO: 2907 - RNA, 19 nt, Artificial Sequence
  Synthetic Oligonucleotide
caaagagacacugugcaga

SEQ ID NO: 2908 - RNA, 19 nt, Artificial Sequence
  Synthetic Oligonucleotide
aaagagacacugugcagag

SEQ ID NO: 2909 - RNA, 19 nt, Artificial Sequence
  Synthetic Oligonucleotide
aagagacacugugcagagg

SEQ ID NO: 2910 - RNA, 19 nt, Artificial Sequence
  Synthetic Oligonucleotide
agagacacugugcagaggg

SEQ ID NO: 2911 - RNA, 19 nt, Artificial Sequence
  Synthetic Oligonucleotide
gagacacugugcagagggu

SEQ ID NO: 2912 - RNA, 19 nt, Artificial Sequence
  Synthetic Oligonucleotide
agacacugugcagagggug

SEQ ID NO: 2913 - RNA, 19 nt, Artificial Sequence
  Synthetic Oligonucleotide
gacacugugcagaggguga

SEQ ID NO: 2914 - RNA, 19 nt, Artificial Sequence
  Synthetic Oligonucleotide
acacugugcagagggugac

SEQ ID NO: 2915 - RNA, 19 nt, Artificial Sequence
  Synthetic Oligonucleotide
cacugugcagagggugacc

SEQ ID NO: 2916 - RNA, 19 nt, Artificial Sequence
  Synthetic Oligonucleotide
acugugcagagggugacca

SEQ ID NO: 2917 - RNA, 19 nt, Artificial Sequence
  Synthetic Oligonucleotide
cugugcagagggugaccac

SEQ ID NO: 2918 - RNA, 19 nt, Artificial Sequence
  Synthetic Oligonucleotide
ugugcagagggugaccaca

SEQ ID NO: 2919 - RNA, 19 nt, Artificial Sequence
  Synthetic Oligonucleotide
agucuguaauuccccacuu

SEQ ID NO: 2920 - RNA, 19 nt, Artificial Sequence
  Synthetic Oligonucleotide
gucuguaauuccccacuuc

SEQ ID NO: 2921 - RNA, 19 nt, Artificial Sequence
  Synthetic Oligonucleotide
ucuguaauuccccacuuca

SEQ ID NO: 2922 - RNA, 19 nt, Artificial Sequence
  Synthetic Oligonucleotide
cuguaauuccccacuucaa

SEQ ID NO: 2923 - RNA, 19 nt, Artificial Sequence
  Synthetic Oligonucleotide
aauacaaagggugucguuc

SEQ ID NO: 2924 - RNA, 19 nt, Artificial Sequence
  Synthetic Oligonucleotide
auacaaagggugucguucu

SEQ ID NO: 2925 - RNA, 19 nt, Artificial Sequence
  Synthetic Oligonucleotide
uacaaagggugucguucuu

SEQ ID NO: 2926 - RNA, 19 nt, Artificial Sequence
  Synthetic Oligonucleotide
acaaagggugucguucuuu

SEQ ID NO: 2927 - RNA, 19 nt, Artificial Sequence
  Synthetic Oligonucleotide
caaagggugucguucuuuu

SEQ ID NO: 2928 - RNA, 19 nt, Artificial Sequence
  Synthetic Oligonucleotide
aaagggugucguucuuuuc

SEQ ID NO: 2929 - RNA, 19 nt, Artificial Sequence
  Synthetic Oligonucleotide
aagggugucguucuuuucc

SEQ ID NO: 2930 - RNA, 19 nt, Artificial Sequence
  Synthetic Oligonucleotide
agggugucguucuuuucca

SEQ ID NO: 2931 - RNA, 19 nt, Artificial Sequence
  Synthetic Oligonucleotide
gggugucguucuuuuccaa

SEQ ID NO: 2932 - RNA, 19 nt, Artificial Sequence
  Synthetic Oligonucleotide
ggugucguucuuuuccaac

SEQ ID NO: 2933 - RNA, 19 nt, Artificial Sequence
  Synthetic Oligonucleotide
gugucguucuuuuccaaca

SEQ ID NO: 2934 - RNA, 19 nt, Artificial Sequence
  Synthetic Oligonucleotide
ugucguucuuuuccaacaa

SEQ ID NO: 2935 - RNA, 19 nt, Artificial Sequence
  Synthetic Oligonucleotide
gucguucuuuuccaacaaa

SEQ ID NO: 2936 - RNA, 19 nt, Artificial Sequence
  Synthetic Oligonucleotide
ucguucuuuuccaacaaaa

SEQ ID NO: 2937 - RNA, 19 nt, Artificial Sequence
  Synthetic Oligonucleotide
cguucuuuuccaacaaaau

SEQ ID NO: 2938 - RNA, 19 nt, Artificial Sequence
  Synthetic Oligonucleotide
guucuuuuccaacaaaaua

SEQ ID NO: 2939 - RNA, 19 nt, Artificial Sequence
  Synthetic Oligonucleotide
uucuuuuccaacaaaauag

SEQ ID NO: 2940 - RNA, 19 nt, Artificial Sequence
  Synthetic Oligonucleotide
ccaacaaaauagcaauccc

SEQ ID NO: 2941 - RNA, 19 nt, Artificial Sequence
  Synthetic Oligonucleotide
caacaaaauagcaaucccu

SEQ ID NO: 2942 - RNA, 19 nt, Artificial Sequence
  Synthetic Oligonucleotide
aacaaaauagcaaucccuu

SEQ ID NO: 2943 - RNA, 19 nt, Artificial Sequence
  Synthetic Oligonucleotide
acaaaauagcaaucccuuu

SEQ ID NO: 2944 - RNA, 19 nt, Artificial Sequence
  Synthetic Oligonucleotide
caaaauagcaaucccuuuu

SEQ ID NO: 2945 - RNA, 19 nt, Artificial Sequence
  Synthetic Oligonucleotide
uuucauugcuuuugacuuu

SEQ ID NO: 2946 - RNA, 19 nt, Artificial Sequence
  Synthetic Oligonucleotide
uucauugcuuuugacuuuu

SEQ ID NO: 2947 - RNA, 19 nt, Artificial Sequence
  Synthetic Oligonucleotide
ucauugcuuuugacuuuuc

SEQ ID NO: 2948 - RNA, 19 nt, Artificial Sequence
  Synthetic Oligonucleotide
cauugcuuuugacuuuuca

SEQ ID NO: 2949 - RNA, 19 nt, Artificial Sequence
  Synthetic Oligonucleotide
auugcuuuugacuuuucaa

SEQ ID NO: 2950 - RNA, 19 nt, Artificial Sequence
  Synthetic Oligonucleotide
uugcuuuugacuuuucaau

SEQ ID NO: 2951 - RNA, 19 nt, Artificial Sequence
  Synthetic Oligonucleotide
ugcuuuugacuuuucaaug

SEQ ID NO: 2952 - RNA, 19 nt, Artificial Sequence
  Synthetic Oligonucleotide
gcuuuugacuuuucaaugg

SEQ ID NO: 2953 - RNA, 19 nt, Artificial Sequence
  Synthetic Oligonucleotide
cuuuugacuuuucaauggg

SEQ ID NO: 2954 - RNA, 19 nt, Artificial Sequence
  Synthetic Oligonucleotide
uuuugacuuuucaaugggu

SEQ ID NO: 2955 - RNA, 19 nt, Artificial Sequence
  Synthetic Oligonucleotide
uuugacuuuucaaugggug

SEQ ID NO: 2956 - RNA, 19 nt, Artificial Sequence
  Synthetic Oligonucleotide
uugacuuuucaaugggugu

SEQ ID NO: 2957 - RNA, 19 nt, Artificial Sequence
  Synthetic Oligonucleotide
ugacuuuucaauggguguc

SEQ ID NO: 2958 - RNA, 19 nt, Artificial Sequence
  Synthetic Oligonucleotide
gacuuuucaaugggugucc

SEQ ID NO: 2959 - RNA, 19 nt, Artificial Sequence
  Synthetic Oligonucleotide
acuuuucaauggguguccu

SEQ ID NO: 2960 - RNA, 19 nt, Artificial Sequence
  Synthetic Oligonucleotide
cuuuucaauggguguccua

SEQ ID NO: 2961 - RNA, 19 nt, Artificial Sequence
  Synthetic Oligonucleotide
uuuucaauggguguccuag

SEQ ID NO: 2962 - RNA, 19 nt, Artificial Sequence
  Synthetic Oligonucleotide
uuucaauggguguccuagg

SEQ ID NO: 2963 - RNA, 19 nt, Artificial Sequence
  Synthetic Oligonucleotide
uucaauggguguccuagga

SEQ ID NO: 2964 - RNA, 19 nt, Artificial Sequence
  Synthetic Oligonucleotide
ucaauggguguccuaggaa

SEQ ID NO: 2965 - RNA, 19 nt, Artificial Sequence
  Synthetic Oligonucleotide
caauggguguccuaggaac

SEQ ID NO: 2966 - RNA, 19 nt, Artificial Sequence
  Synthetic Oligonucleotide
aauggguguccuaggaacc

SEQ ID NO: 2967 - RNA, 19 nt, Artificial Sequence
  Synthetic Oligonucleotide
auggguguccuaggaaccu

SEQ ID NO: 2968 - RNA, 19 nt, Artificial Sequence
  Synthetic Oligonucleotide
gaaauggacuuucauccug

SEQ ID NO: 2969 - RNA, 19 nt, Artificial Sequence
  Synthetic Oligonucleotide
aaauggacuuucauccugg

SEQ ID NO: 2970 - RNA, 19 nt, Artificial Sequence
  Synthetic Oligonucleotide
aauggacuuucauccugga

SEQ ID NO: 2971 - RNA, 19 nt, Artificial Sequence
  Synthetic Oligonucleotide
auggacuuucauccuggaa

SEQ ID NO: 2972 - RNA, 19 nt, Artificial Sequence
  Synthetic Oligonucleotide
uggacuuucauccuggaaa

SEQ ID NO: 2973 - RNA, 19 nt, Artificial Sequence
  Synthetic Oligonucleotide
ggacuuucauccuggaaau

SEQ ID NO: 2974 - RNA, 19 nt, Artificial Sequence
  Synthetic Oligonucleotide
gacuuucauccuggaaaua

SEQ ID NO: 2975 - RNA, 19 nt, Artificial Sequence
  Synthetic Oligonucleotide
acuuucauccuggaaauau

SEQ ID NO: 2976 - RNA, 19 nt, Artificial Sequence
  Synthetic Oligonucleotide
cuuucauccuggaaauaua

SEQ ID NO: 2977 - RNA, 19 nt, Artificial Sequence
  Synthetic Oligonucleotide
uuucauccuggaaauauau

SEQ ID NO: 2978 - RNA, 19 nt, Artificial Sequence
  Synthetic Oligonucleotide
uucauccuggaaauauauu

SEQ ID NO: 2979 - RNA, 19 nt, Artificial Sequence
  Synthetic Oligonucleotide
ucauccuggaaauauauua

SEQ ID NO: 2980 - RNA, 19 nt, Artificial Sequence
  Synthetic Oligonucleotide
cauccuggaaauauauuaa

SEQ ID NO: 2981 - RNA, 19 nt, Artificial Sequence
  Synthetic Oligonucleotide
auccuggaaauauauuaac

SEQ ID NO: 2982 - RNA, 19 nt, Artificial Sequence
  Synthetic Oligonucleotide
uccuggaaauauauuaacu

SEQ ID NO: 2983 - RNA, 19 nt, Artificial Sequence
  Synthetic Oligonucleotide
ccuggaaauauauuaacug

SEQ ID NO: 2984 - RNA, 19 nt, Artificial Sequence
  Synthetic Oligonucleotide
cuggaaauauauuaacugu

SEQ ID NO: 2985 - RNA, 19 nt, Artificial Sequence
  Synthetic Oligonucleotide
uggaaauauauuaacuguu

SEQ ID NO: 2986 - RNA, 19 nt, Artificial Sequence
  Synthetic Oligonucleotide
ggaaauauauuaacuguua

SEQ ID NO: 2987 - RNA, 19 nt, Artificial Sequence
  Synthetic Oligonucleotide
gaaauauauuaacuguuaa

SEQ ID NO: 2988 - RNA, 19 nt, Artificial Sequence
  Synthetic Oligonucleotide
aaauauauuaacuguuaaa

SEQ ID NO: 2989 - RNA, 19 nt, Artificial Sequence
  Synthetic Oligonucleotide
aauauauuaacuguuaaaa

SEQ ID NO: 2990 - RNA, 19 nt, Artificial Sequence
  Synthetic Oligonucleotide
auauauuaacuguuaaaaa

SEQ ID NO: 2991 - RNA, 19 nt, Artificial Sequence
  Synthetic Oligonucleotide
uauauuaacuguuaaaaag

SEQ ID NO: 2992 - RNA, 19 nt, Artificial Sequence
  Synthetic Oligonucleotide
auauuaacuguuaaaaaga

SEQ ID NO: 2993 - RNA, 19 nt, Artificial Sequence
  Synthetic Oligonucleotide
uauuaacuguuaaaaagaa

SEQ ID NO: 2994 - RNA, 19 nt, Artificial Sequence
  Synthetic Oligonucleotide
auuaacuguuaaaaagaaa

SEQ ID NO: 2995 - RNA, 19 nt, Artificial Sequence
  Synthetic Oligonucleotide
uuaacuguuaaaaagaaaa

SEQ ID NO: 2996 - RNA, 19 nt, Artificial Sequence
  Synthetic Oligonucleotide
uaacuguuaaaaagaaaac

SEQ ID NO: 2997 - RNA, 19 nt, Artificial Sequence
  Synthetic Oligonucleotide
aacuguuaaaaagaaaaca

SEQ ID NO: 2998 - RNA, 19 nt, Artificial Sequence
  Synthetic Oligonucleotide
acuguuaaaaagaaaacau

SEQ ID NO: 2999 - RNA, 19 nt, Artificial Sequence
  Synthetic Oligonucleotide
cuguuaaaaagaaaacauu

SEQ ID NO: 3000 - RNA, 19 nt, Artificial Sequence
  Synthetic Oligonucleotide
uguuaaaaagaaaacauug

SEQ ID NO: 3001 - RNA, 19 nt, Artificial Sequence
  Synthetic Oligonucleotide
guuaaaaagaaaacauuga

SEQ ID NO: 3002 - RNA, 19 nt, Artificial Sequence
  Synthetic Oligonucleotide
acaacgucauccccuggca

SEQ ID NO: 3003 - RNA, 19 nt, Artificial Sequence
  Synthetic Oligonucleotide
caacgucauccccuggcag

SEQ ID NO: 3004 - RNA, 19 nt, Artificial Sequence
  Synthetic Oligonucleotide
aacgucauccccuggcagg

SEQ ID NO: 3005 - RNA, 19 nt, Artificial Sequence
  Synthetic Oligonucleotide
acgucauccccuggcaggc

SEQ ID NO: 3006 - RNA, 19 nt, Artificial Sequence
  Synthetic Oligonucleotide
cgucauccccuggcaggcu

SEQ ID NO: 3007 - RNA, 19 nt, Artificial Sequence
  Synthetic Oligonucleotide
gucauccccuggcaggcua

SEQ ID NO: 3008 - RNA, 19 nt, Artificial Sequence
  Synthetic Oligonucleotide
ucauccccuggcaggcuaa

SEQ ID NO: 3009 - RNA, 19 nt, Artificial Sequence
  Synthetic Oligonucleotide
cauccccuggcaggcuaaa

SEQ ID NO: 3010 - RNA, 19 nt, Artificial Sequence
  Synthetic Oligonucleotide
auccccuggcaggcuaaag

SEQ ID NO: 3011 - RNA, 19 nt, Artificial Sequence
  Synthetic Oligonucleotide
uccccuggcaggcuaaagu

SEQ ID NO: 3012 - RNA, 19 nt, Artificial Sequence
  Synthetic Oligonucleotide
ccccuggcaggcuaaagug

SEQ ID NO: 3013 - RNA, 19 nt, Artificial Sequence
  Synthetic Oligonucleotide
cccuggcaggcuaaagugc

SEQ ID NO: 3014 - RNA, 19 nt, Artificial Sequence
  Synthetic Oligonucleotide
ccuggcaggcuaaagugcu

SEQ ID NO: 3015 - RNA, 19 nt, Artificial Sequence
  Synthetic Oligonucleotide
gguagcaaacacuaaggug

SEQ ID NO: 3016 - RNA, 19 nt, Artificial Sequence
  Synthetic Oligonucleotide
guagcaaacacuaagguga

SEQ ID NO: 3017 - RNA, 19 nt, Artificial Sequence
  Synthetic Oligonucleotide
uagcaaacacuaaggugaa

SEQ ID NO: 3018 - RNA, 19 nt, Artificial Sequence
  Synthetic Oligonucleotide
agcaaacacuaaggugaaa

SEQ ID NO: 3019 - RNA, 19 nt, Artificial Sequence
  Synthetic Oligonucleotide
caaacacuaaggugaaaag

SEQ ID NO: 3020 - RNA, 19 nt, Artificial Sequence
  Synthetic Oligonucleotide
aaacacuaaggugaaaaga

SEQ ID NO: 3021 - RNA, 19 nt, Artificial Sequence
  Synthetic Oligonucleotide
acuaaggugaaaagauaau

SEQ ID NO: 3022 - RNA, 19 nt, Artificial Sequence
  Synthetic Oligonucleotide
cuaaggugaaaagauaaug

SEQ ID NO: 3023 - RNA, 19 nt, Artificial Sequence
  Synthetic Oligonucleotide
uaaggugaaaagauaauga

SEQ ID NO: 3024 - RNA, 19 nt, Artificial Sequence
  Synthetic Oligonucleotide
aaggugaaaagauaaugau

SEQ ID NO: 3025 - RNA, 19 nt, Artificial Sequence
  Synthetic Oligonucleotide
aggugaaaagauaaugauc

SEQ ID NO: 3026 - RNA, 19 nt, Artificial Sequence
  Synthetic Oligonucleotide
ggugaaaagauaaugaucu

SEQ ID NO: 3027 - RNA, 19 nt, Artificial Sequence
  Synthetic Oligonucleotide
gugaaaagauaaugaucuc

SEQ ID NO: 3028 - RNA, 19 nt, Artificial Sequence
  Synthetic Oligonucleotide
ugaaaagauaaugaucuca

SEQ ID NO: 3029 - RNA, 19 nt, Artificial Sequence
  Synthetic Oligonucleotide
gaaaagauaaugaucucau

SEQ ID NO: 3030 - RNA, 19 nt, Artificial Sequence
  Synthetic Oligonucleotide
aaaagauaaugaucucauu

SEQ ID NO: 3031 - RNA, 19 nt, Artificial Sequence
  Synthetic Oligonucleotide
aaagauaaugaucucauug

SEQ ID NO: 3032 - RNA, 19 nt, Artificial Sequence
  Synthetic Oligonucleotide
aagauaaugaucucauugu

SEQ ID NO: 3033 - RNA, 19 nt, Artificial Sequence
  Synthetic Oligonucleotide
agauaaugaucucauuguu

SEQ ID NO: 3034 - RNA, 19 nt, Artificial Sequence
  Synthetic Oligonucleotide
gauaaugaucucauuguuu

SEQ ID NO: 3035 - RNA, 19 nt, Artificial Sequence
  Synthetic Oligonucleotide
auaaugaucucauuguuua

SEQ ID NO: 3036 - RNA, 19 nt, Artificial Sequence
  Synthetic Oligonucleotide
uaaugaucucauuguuuau

SEQ ID NO: 3037 - RNA, 19 nt, Artificial Sequence
  Synthetic Oligonucleotide
aaugaucucauuguuuauu

SEQ ID NO: 3038 - RNA, 19 nt, Artificial Sequence
  Synthetic Oligonucleotide
augaucucauuguuuauua

SEQ ID NO: 3039 - RNA, 19 nt, Artificial Sequence
  Synthetic Oligonucleotide
ugaucucauuguuuauuaa

SEQ ID NO: 3040 - RNA, 19 nt, Artificial Sequence
  Synthetic Oligonucleotide
gaucucauuguuuauuaac

SEQ ID NO: 3041 - RNA, 19 nt, Artificial Sequence
  Synthetic Oligonucleotide
aucucauuguuuauuaacc

SEQ ID NO: 3042 - RNA, 19 nt, Artificial Sequence
  Synthetic Oligonucleotide
ucucauuguuuauuaaccu

SEQ ID NO: 3043 - RNA, 19 nt, Artificial Sequence
  Synthetic Oligonucleotide
cucauuguuuauuaaccug

SEQ ID NO: 3044 - RNA, 19 nt, Artificial Sequence
  Synthetic Oligonucleotide
ucauuguuuauuaaccugu

SEQ ID NO: 3045 - RNA, 19 nt, Artificial Sequence
  Synthetic Oligonucleotide
cauuguuuauuaaccugua

SEQ ID NO: 3046 - RNA, 19 nt, Artificial Sequence
  Synthetic Oligonucleotide
uguuuauuaaccuguauuc

SEQ ID NO: 3047 - RNA, 19 nt, Artificial Sequence
  Synthetic Oligonucleotide
guuuauuaaccuguauucu

SEQ ID NO: 3048 - RNA, 19 nt, Artificial Sequence
  Synthetic Oligonucleotide
uauuaaccuguauucuguu

SEQ ID NO: 3049 - RNA, 19 nt, Artificial Sequence
  Synthetic Oligonucleotide
auuaaccuguauucuguuu

SEQ ID NO: 3050 - RNA, 19 nt, Artificial Sequence
  Synthetic Oligonucleotide
uuuaaaacagugguucuua

SEQ ID NO: 3051 - RNA, 19 nt, Artificial Sequence
  Synthetic Oligonucleotide
uuaaaacagugguucuuaa

SEQ ID NO: 3052 - RNA, 19 nt, Artificial Sequence
  Synthetic Oligonucleotide
uaaaacagugguucuuaaa

SEQ ID NO: 3053 - RNA, 19 nt, Artificial Sequence
  Synthetic Oligonucleotide
aaaacagugguucuuaaau

SEQ ID NO: 3054 - RNA, 19 nt, Artificial Sequence
  Synthetic Oligonucleotide
aaacagugguucuuaaauu

SEQ ID NO: 3055 - RNA, 19 nt, Artificial Sequence
  Synthetic Oligonucleotide
aacagugguucuuaaauug

SEQ ID NO: 3056 - RNA, 19 nt, Artificial Sequence
  Synthetic Oligonucleotide
acagugguucuuaaauugu

SEQ ID NO: 3057 - RNA, 19 nt, Artificial Sequence
  Synthetic Oligonucleotide
gguucuuaaauuguaagcu

SEQ ID NO: 3058 - RNA, 19 nt, Artificial Sequence
  Synthetic Oligonucleotide
ucuuaaauuguaagcucag

SEQ ID NO: 3059 - RNA, 19 nt, Artificial Sequence
  Synthetic Oligonucleotide
cuuaaauuguaagcucagg

SEQ ID NO: 3060 - RNA, 19 nt, Artificial Sequence
  Synthetic Oligonucleotide
uaaauuguaagcucagguu

SEQ ID NO: 3061 - RNA, 19 nt, Artificial Sequence
  Synthetic Oligonucleotide
aaauuguaagcucagguuc

SEQ ID NO: 3062 - RNA, 19 nt, Artificial Sequence
  Synthetic Oligonucleotide
aauuguaagcucagguuca

SEQ ID NO: 3063 - RNA, 19 nt, Artificial Sequence
  Synthetic Oligonucleotide
uggugauacuucuuugaau

SEQ ID NO: 3064 - RNA, 19 nt, Artificial Sequence
  Synthetic Oligonucleotide
aaucacaucuuuagugucu

SEQ ID NO: 3065 - RNA, 19 nt, Artificial Sequence
  Synthetic Oligonucleotide
uuagugucugaauauaucc

SEQ ID NO: 3066 - RNA, 19 nt, Artificial Sequence
  Synthetic Oligonucleotide
uagugucugaauauaucca

SEQ ID NO: 3067 - RNA, 19 nt, Artificial Sequence
  Synthetic Oligonucleotide
agugucugaauauauccaa

SEQ ID NO: 3068 - RNA, 19 nt, Artificial Sequence
  Synthetic Oligonucleotide
ugucugaauauauccaaau

SEQ ID NO: 3069 - RNA, 19 nt, Artificial Sequence
  Synthetic Oligonucleotide
gucugaauauauccaaaug

SEQ ID NO: 3070 - RNA, 19 nt, Artificial Sequence
  Synthetic Oligonucleotide
ucugaauauauccaaaugu

SEQ ID NO: 3071 - RNA, 19 nt, Artificial Sequence
  Synthetic Oligonucleotide
cugaauauauccaaauguu

SEQ ID NO: 3072 - RNA, 19 nt, Artificial Sequence
  Synthetic Oligonucleotide
ugaauauauccaaauguuu

SEQ ID NO: 3073 - RNA, 19 nt, Artificial Sequence
  Synthetic Oligonucleotide
ccggcuaauuuguaucaau

SEQ ID NO: 3074 - RNA, 19 nt, Artificial Sequence
  Synthetic Oligonucleotide
cggcuaauuuguaucaaug

SEQ ID NO: 3075 - RNA, 19 nt, Artificial Sequence
  Synthetic Oligonucleotide
ggcuaauuuguaucaauga

SEQ ID NO: 3076 - RNA, 19 nt, Artificial Sequence
  Synthetic Oligonucleotide
gcuaauuuguaucaaugau

SEQ ID NO: 3077 - RNA, 19 nt, Artificial Sequence
  Synthetic Oligonucleotide
cuaauuuguaucaaugauu

SEQ ID NO: 3078 - RNA, 19 nt, Artificial Sequence
  Synthetic Oligonucleotide
uaauuuguaucaaugauua

SEQ ID NO: 3079 - RNA, 19 nt, Artificial Sequence
  Synthetic Oligonucleotide
aauuuguaucaaugauuau

SEQ ID NO: 3080 - RNA, 19 nt, Artificial Sequence
  Synthetic Oligonucleotide
auuuguaucaaugauuaug

SEQ ID NO: 3081 - RNA, 19 nt, Artificial Sequence
  Synthetic Oligonucleotide
uuuguaucaaugauuauga

SEQ ID NO: 3082 - RNA, 19 nt, Artificial Sequence
  Synthetic Oligonucleotide
uuguaucaaugauuaugaa

SEQ ID NO: 3083 - RNA, 19 nt, Artificial Sequence
  Synthetic Oligonucleotide
guaucaaugauuaugaaca

SEQ ID NO: 3084 - RNA, 19 nt, Artificial Sequence
  Synthetic Oligonucleotide
uaucaaugauuaugaacaa

SEQ ID NO: 3085 - RNA, 19 nt, Artificial Sequence
  Synthetic Oligonucleotide
aucaaugauuaugaacaac

SEQ ID NO: 3086 - RNA, 19 nt, Artificial Sequence
  Synthetic Oligonucleotide
ucaaugauuaugaacaaca

SEQ ID NO: 3087 - RNA, 19 nt, Artificial Sequence
  Synthetic Oligonucleotide
caaugauuaugaacaacau

SEQ ID NO: 3088 - RNA, 19 nt, Artificial Sequence
  Synthetic Oligonucleotide
aaugauuaugaacaacaug

SEQ ID NO: 3089 - RNA, 19 nt, Artificial Sequence
  Synthetic Oligonucleotide
augauuaugaacaacaugc

SEQ ID NO: 3090 - RNA, 19 nt, Artificial Sequence
  Synthetic Oligonucleotide
ugauuaugaacaacaugcu

SEQ ID NO: 3091 - RNA, 19 nt, Artificial Sequence
  Synthetic Oligonucleotide
uuaugaacaacaugcuaaa

SEQ ID NO: 3092 - RNA, 19 nt, Artificial Sequence
  Synthetic Oligonucleotide
augaacaacaugcuaaauc

SEQ ID NO: 3093 - RNA, 19 nt, Artificial Sequence
  Synthetic Oligonucleotide
ugaacaacaugcuaaauca

SEQ ID NO: 3094 - RNA, 19 nt, Artificial Sequence
  Synthetic Oligonucleotide
acaacaugcuaaaucagua

SEQ ID NO: 3095 - RNA, 19 nt, Artificial Sequence
  Synthetic Oligonucleotide
uaaaucaguacuuccaaag

SEQ ID NO: 3096 - RNA, 19 nt, Artificial Sequence
  Synthetic Oligonucleotide
aaaucaguacuuccaaagu

SEQ ID NO: 3097 - RNA, 19 nt, Artificial Sequence
  Synthetic Oligonucleotide
aucaguacuuccaaagucu

SEQ ID NO: 3098 - RNA, 19 nt, Artificial Sequence
  Synthetic Oligonucleotide
ucaguacuuccaaagucua

SEQ ID NO: 3099 - RNA, 19 nt, Artificial Sequence
  Synthetic Oligonucleotide
caguacuuccaaagucuau

SEQ ID NO: 3100 - RNA, 19 nt, Artificial Sequence
  Synthetic Oligonucleotide
uacuuccaaagucuauaua

SEQ ID NO: 3101 - RNA, 19 nt, Artificial Sequence
  Synthetic Oligonucleotide
uuccaaagucuauauauga

SEQ ID NO: 3102 - RNA, 19 nt, Artificial Sequence
  Synthetic Oligonucleotide
uccaaagucuauauaugac

SEQ ID NO: 3103 - RNA, 19 nt, Artificial Sequence
  Synthetic Oligonucleotide
caaagucuauauaugacua

SEQ ID NO: 3104 - RNA, 19 nt, Artificial Sequence
  Synthetic Oligonucleotide
uauaugacuauuacagguc

SEQ ID NO: 3105 - RNA, 19 nt, Artificial Sequence
  Synthetic Oligonucleotide
auaugacuauuacaggucu

SEQ ID NO: 3106 - RNA, 19 nt, Artificial Sequence
  Synthetic Oligonucleotide
uaugacuauuacaggucug

SEQ ID NO: 3107 - RNA, 19 nt, Artificial Sequence
  Synthetic Oligonucleotide
augacuauuacaggucugg

SEQ ID NO: 3108 - RNA, 19 nt, Artificial Sequence
  Synthetic Oligonucleotide
ugacuauuacaggucuggg

SEQ ID NO: 3109 - RNA, 19 nt, Artificial Sequence
  Synthetic Oligonucleotide
gacuauuacaggucugggg

SEQ ID NO: 3110 - RNA, 19 nt, Artificial Sequence
  Synthetic Oligonucleotide
acuauuacaggucuggggc

SEQ ID NO: 3111 - RNA, 19 nt, Artificial Sequence
  Synthetic Oligonucleotide
cuauuacaggucuggggca

SEQ ID NO: 3112 - RNA, 19 nt, Artificial Sequence
  Synthetic Oligonucleotide
uauuacaggucuggggcaa

SEQ ID NO: 3113 - RNA, 19 nt, Artificial Sequence
  Synthetic Oligonucleotide
auuacaggucuggggcaaa

SEQ ID NO: 3114 - RNA, 19 nt, Artificial Sequence
  Synthetic Oligonucleotide
uuacaggucuggggcaaau

SEQ ID NO: 3115 - RNA, 19 nt, Artificial Sequence
  Synthetic Oligonucleotide
uacaggucuggggcaaaug

SEQ ID NO: 3116 - RNA, 19 nt, Artificial Sequence
  Synthetic Oligonucleotide
ccggaauguugcugaaaca

SEQ ID NO: 3117 - RNA, 19 nt, Artificial Sequence
  Synthetic Oligonucleotide
cgacuucuguuuuaggaca

SEQ ID NO: 3118 - RNA, 19 nt, Artificial Sequence
  Synthetic Oligonucleotide
gacuucuguuuuaggacag

SEQ ID NO: 3119 - RNA, 19 nt, Artificial Sequence
  Synthetic Oligonucleotide
gcuacaaggccauauuugu

SEQ ID NO: 3120 - RNA, 19 nt, Artificial Sequence
  Synthetic Oligonucleotide
cuacaaggccauauuugug

SEQ ID NO: 3121 - RNA, 19 nt, Artificial Sequence
  Synthetic Oligonucleotide
cgccacaacucaggaugaa

SEQ ID NO: 3122 - RNA, 19 nt, Artificial Sequence
  Synthetic Oligonucleotide
gccacaacucaggaugaaa

SEQ ID NO: 3123 - RNA, 19 nt, Artificial Sequence
  Synthetic Oligonucleotide
ccacaacucaggaugaaaa

SEQ ID NO: 3124 - RNA, 19 nt, Artificial Sequence
  Synthetic Oligonucleotide
cacaacucaggaugaaaaa

SEQ ID NO: 3125 - RNA, 19 nt, Artificial Sequence
  Synthetic Oligonucleotide
acaacucaggaugaaaaau

SEQ ID NO: 3126 - RNA, 19 nt, Artificial Sequence
  Synthetic Oligonucleotide
aacucaggaugaaaaauuu

SEQ ID NO: 3127 - RNA, 19 nt, Artificial Sequence
  Synthetic Oligonucleotide
acucaggaugaaaaauuuu

SEQ ID NO: 3128 - RNA, 19 nt, Artificial Sequence
  Synthetic Oligonucleotide
cucaggaugaaaaauuuug

SEQ ID NO: 3129 - RNA, 19 nt, Artificial Sequence
  Synthetic Oligonucleotide
ucaggaugaaaaauuuuga

SEQ ID NO: 3130 - RNA, 19 nt, Artificial Sequence
  Synthetic Oligonucleotide
aggaugaaaaauuuugaaa

SEQ ID NO: 3131 - RNA, 19 nt, Artificial Sequence
  Synthetic Oligonucleotide
ggaugaaaaauuuugaaac

SEQ ID NO: 3132 - RNA, 19 nt, Artificial Sequence
  Synthetic Oligonucleotide
gaugaaaaauuuugaaacc

SEQ ID NO: 3133 - RNA, 19 nt, Artificial Sequence
  Synthetic Oligonucleotide
augaaaaauuuugaaacca

SEQ ID NO: 3134 - RNA, 19 nt, Artificial Sequence
  Synthetic Oligonucleotide
ugaaaaauuuugaaaccag

SEQ ID NO: 3135 - RNA, 19 nt, Artificial Sequence
  Synthetic Oligonucleotide
gaaaaauuuugaaaccagu

SEQ ID NO: 3136 - RNA, 19 nt, Artificial Sequence
  Synthetic Oligonucleotide
aaaaauuuugaaaccagua

SEQ ID NO: 3137 - RNA, 19 nt, Artificial Sequence
  Synthetic Oligonucleotide
aaaauuuugaaaccaguac

SEQ ID NO: 3138 - RNA, 19 nt, Artificial Sequence
  Synthetic Oligonucleotide
aaauuuugaaaccaguacu

SEQ ID NO: 3139 - RNA, 19 nt, Artificial Sequence
  Synthetic Oligonucleotide
aauuuugaaaccaguacuu

SEQ ID NO: 3140 - RNA, 19 nt, Artificial Sequence
  Synthetic Oligonucleotide
auuuugaaaccaguacuuu

SEQ ID NO: 3141 - RNA, 19 nt, Artificial Sequence
  Synthetic Oligonucleotide
uuuugaaaccaguacuuua

SEQ ID NO: 3142 - RNA, 19 nt, Artificial Sequence
  Synthetic Oligonucleotide
uuugaaaccaguacuuuau

SEQ ID NO: 3143 - RNA, 19 nt, Artificial Sequence
  Synthetic Oligonucleotide
uugaaaccaguacuuuauc

SEQ ID NO: 3144 - RNA, 19 nt, Artificial Sequence
  Synthetic Oligonucleotide
ugaaaccaguacuuuauca

SEQ ID NO: 3145 - RNA, 19 nt, Artificial Sequence
  Synthetic Oligonucleotide
gaaaccaguacuuuaucau

SEQ ID NO: 3146 - RNA, 19 nt, Artificial Sequence
  Synthetic Oligonucleotide
aaccaguacuuuaucauuu

SEQ ID NO: 3147 - RNA, 19 nt, Artificial Sequence
  Synthetic Oligonucleotide
accaguacuuuaucauuuu

SEQ ID NO: 3148 - RNA, 19 nt, Artificial Sequence
  Synthetic Oligonucleotide
uuaucauuuucuccugagg

SEQ ID NO: 3149 - RNA, 19 nt, Artificial Sequence
  Synthetic Oligonucleotide
caaauggcugagaagacug

SEQ ID NO: 3150 - RNA, 19 nt, Artificial Sequence
  Synthetic Oligonucleotide
gcaaagggcauuuugagag

SEQ ID NO: 3151 - RNA, 19 nt, Artificial Sequence
  Synthetic Oligonucleotide
caaagggcauuuugagagg

SEQ ID NO: 3152 - RNA, 19 nt, Artificial Sequence
  Synthetic Oligonucleotide
aaagggcauuuugagaggu

SEQ ID NO: 3153 - RNA, 19 nt, Artificial Sequence
  Synthetic Oligonucleotide
aagggcauuuugagaggug

SEQ ID NO: 3154 - RNA, 19 nt, Artificial Sequence
  Synthetic Oligonucleotide
agggcauuuugagagguga

SEQ ID NO: 3155 - RNA, 19 nt, Artificial Sequence
  Synthetic Oligonucleotide
gggcauuuugagaggugau

SEQ ID NO: 3156 - RNA, 19 nt, Artificial Sequence
  Synthetic Oligonucleotide
ggcauuuugagaggugaug

SEQ ID NO: 3157 - RNA, 19 nt, Artificial Sequence
  Synthetic Oligonucleotide
gcauuuugagaggugauga

SEQ ID NO: 3158 - RNA, 19 nt, Artificial Sequence
  Synthetic Oligonucleotide
cauuuugagaggugaugau

SEQ ID NO: 3159 - RNA, 19 nt, Artificial Sequence
  Synthetic Oligonucleotide
auuuugagaggugaugaug

SEQ ID NO: 3160 - RNA, 19 nt, Artificial Sequence
  Synthetic Oligonucleotide
uuuugagaggugaugaugc

SEQ ID NO: 3161 - RNA, 19 nt, Artificial Sequence
  Synthetic Oligonucleotide
gaaugggaucuuggugucg

SEQ ID NO: 3162 - RNA, 19 nt, Artificial Sequence
  Synthetic Oligonucleotide
aaugggaucuuggugucga

SEQ ID NO: 3163 - RNA, 19 nt, Artificial Sequence
  Synthetic Oligonucleotide
augggaucuuggugucgaa

SEQ ID NO: 3164 - RNA, 19 nt, Artificial Sequence
  Synthetic Oligonucleotide
ugggaucuuggugucgaau

SEQ ID NO: 3165 - RNA, 19 nt, Artificial Sequence
  Synthetic Oligonucleotide
gggaucuuggugucgaauc

SEQ ID NO: 3166 - RNA, 19 nt, Artificial Sequence
  Synthetic Oligonucleotide
ggaucuuggugucgaauca

SEQ ID NO: 3167 - RNA, 19 nt, Artificial Sequence
  Synthetic Oligonucleotide
gaucuuggugucgaaucau

SEQ ID NO: 3168 - RNA, 19 nt, Artificial Sequence
  Synthetic Oligonucleotide
aucuuggugucgaaucaug

SEQ ID NO: 3169 - RNA, 19 nt, Artificial Sequence
  Synthetic Oligonucleotide
ucuuggugucgaaucaugg

SEQ ID NO: 3170 - RNA, 19 nt, Artificial Sequence
  Synthetic Oligonucleotide
cuuggugucgaaucauggg

SEQ ID NO: 3171 - RNA, 19 nt, Artificial Sequence
  Synthetic Oligonucleotide
agccacuauugauguucug

SEQ ID NO: 3172 - RNA, 19 nt, Artificial Sequence
  Synthetic Oligonucleotide
cacuauugauguucugcca

SEQ ID NO: 3173 - RNA, 19 nt, Artificial Sequence
  Synthetic Oligonucleotide
acuauugauguucugccag

SEQ ID NO: 3174 - RNA, 19 nt, Artificial Sequence
  Synthetic Oligonucleotide
uggaggcuguggaagggaa

SEQ ID NO: 3175 - RNA, 19 nt, Artificial Sequence
  Synthetic Oligonucleotide
ggaggcuguggaagggaag

SEQ ID NO: 3176 - RNA, 19 nt, Artificial Sequence
  Synthetic Oligonucleotide
ggggagaaagguguucaag

SEQ ID NO: 3177 - RNA, 19 nt, Artificial Sequence
  Synthetic Oligonucleotide
gggagaaagguguucaaga

SEQ ID NO: 3178 - RNA, 19 nt, Artificial Sequence
  Synthetic Oligonucleotide
ggagaaagguguucaagau

SEQ ID NO: 3179 - RNA, 19 nt, Artificial Sequence
  Synthetic Oligonucleotide
gagaaagguguucaagaug

SEQ ID NO: 3180 - RNA, 19 nt, Artificial Sequence
  Synthetic Oligonucleotide
agaaagguguucaagaugu

SEQ ID NO: 3181 - RNA, 19 nt, Artificial Sequence
  Synthetic Oligonucleotide
gaaagguguucaagauguc

SEQ ID NO: 3182 - RNA, 19 nt, Artificial Sequence
  Synthetic Oligonucleotide
aaagguguucaagaugucc

SEQ ID NO: 3183 - RNA, 19 nt, Artificial Sequence
  Synthetic Oligonucleotide
aagguguucaagauguccu

SEQ ID NO: 3184 - RNA, 19 nt, Artificial Sequence
  Synthetic Oligonucleotide
agguguucaagauguccuc

SEQ ID NO: 3185 - RNA, 19 nt, Artificial Sequence
  Synthetic Oligonucleotide
gguguucaagauguccucg

SEQ ID NO: 3186 - RNA, 19 nt, Artificial Sequence
  Synthetic Oligonucleotide
guguucaagauguccucga

SEQ ID NO: 3187 - RNA, 19 nt, Artificial Sequence
  Synthetic Oligonucleotide
uguucaagauguccucgag

SEQ ID NO: 3188 - RNA, 19 nt, Artificial Sequence
  Synthetic Oligonucleotide
guucaagauguccucgaga

SEQ ID NO: 3189 - RNA, 19 nt, Artificial Sequence
  Synthetic Oligonucleotide
guuggccauggcucugagu

SEQ ID NO: 3190 - RNA, 19 nt, Artificial Sequence
  Synthetic Oligonucleotide
uuggccauggcucugagug

SEQ ID NO: 3191 - RNA, 19 nt, Artificial Sequence
  Synthetic Oligonucleotide
uggccauggcucugagugg

SEQ ID NO: 3192 - RNA, 19 nt, Artificial Sequence
  Synthetic Oligonucleotide
ggccauggcucugaguggg

SEQ ID NO: 3193 - RNA, 19 nt, Artificial Sequence
  Synthetic Oligonucleotide
gccauggcucugagugggu

SEQ ID NO: 3194 - RNA, 19 nt, Artificial Sequence
  Synthetic Oligonucleotide
ccauggcucugagugggug

SEQ ID NO: 3195 - RNA, 19 nt, Artificial Sequence
  Synthetic Oligonucleotide
cauggcucugagugggugc

SEQ ID NO: 3196 - RNA, 19 nt, Artificial Sequence
  Synthetic Oligonucleotide
auggcucugagugggugcc

SEQ ID NO: 3197 - RNA, 19 nt, Artificial Sequence
  Synthetic Oligonucleotide
uggcucugagugggugcca

SEQ ID NO: 3198 - RNA, 19 nt, Artificial Sequence
  Synthetic Oligonucleotide
ggcucugagugggugccag

SEQ ID NO: 3199 - RNA, 19 nt, Artificial Sequence
  Synthetic Oligonucleotide
gcucugagugggugccaga

SEQ ID NO: 3200 - RNA, 19 nt, Artificial Sequence
  Synthetic Oligonucleotide
cucugagugggugccagaa

SEQ ID NO: 3201 - RNA, 19 nt, Artificial Sequence
  Synthetic Oligonucleotide
ucugagugggugccagaau

SEQ ID NO: 3202 - RNA, 19 nt, Artificial Sequence
  Synthetic Oligonucleotide
cugagugggugccagaaug

SEQ ID NO: 3203 - RNA, 19 nt, Artificial Sequence
  Synthetic Oligonucleotide
ugagugggugccagaaugu

SEQ ID NO: 3204 - RNA, 19 nt, Artificial Sequence
  Synthetic Oligonucleotide
gagugggugccagaaugug

SEQ ID NO: 3205 - RNA, 19 nt, Artificial Sequence
  Synthetic Oligonucleotide
agugggugccagaauguga

SEQ ID NO: 3206 - RNA, 19 nt, Artificial Sequence
  Synthetic Oligonucleotide
gugggugccagaaugugaa

SEQ ID NO: 3207 - RNA, 19 nt, Artificial Sequence
  Synthetic Oligonucleotide
ugggugccagaaugugaaa

SEQ ID NO: 3208 - RNA, 19 nt, Artificial Sequence
  Synthetic Oligonucleotide
gggugccagaaugugaaag

SEQ ID NO: 3209 - RNA, 19 nt, Artificial Sequence
  Synthetic Oligonucleotide
ggugccagaaugugaaagu

SEQ ID NO: 3210 - RNA, 19 nt, Artificial Sequence
  Synthetic Oligonucleotide
gugccagaaugugaaaguc

SEQ ID NO: 3211 - RNA, 19 nt, Artificial Sequence
  Synthetic Oligonucleotide
ugccagaaugugaaaguca

SEQ ID NO: 3212 - RNA, 19 nt, Artificial Sequence
  Synthetic Oligonucleotide
gccagaaugugaaagucau

SEQ ID NO: 3213 - RNA, 19 nt, Artificial Sequence
  Synthetic Oligonucleotide
ccagaaugugaaagucauc

SEQ ID NO: 3214 - RNA, 19 nt, Artificial Sequence
  Synthetic Oligonucleotide
cagaaugugaaagucaucg

SEQ ID NO: 3215 - RNA, 19 nt, Artificial Sequence
  Synthetic Oligonucleotide
agaaugugaaagucaucga

SEQ ID NO: 3216 - RNA, 19 nt, Artificial Sequence
  Synthetic Oligonucleotide
gaaugugaaagucaucgac

SEQ ID NO: 3217 - RNA, 19 nt, Artificial Sequence
  Synthetic Oligonucleotide
aaugugaaagucaucgaca

SEQ ID NO: 3218 - RNA, 19 nt, Artificial Sequence
  Synthetic Oligonucleotide
augugaaagucaucgacaa

SEQ ID NO: 3219 - RNA, 19 nt, Artificial Sequence
  Synthetic Oligonucleotide
ugugaaagucaucgacaag

SEQ ID NO: 3220 - RNA, 19 nt, Artificial Sequence
  Synthetic Oligonucleotide
gugaaagucaucgacaaga

SEQ ID NO: 3221 - RNA, 19 nt, Artificial Sequence
  Synthetic Oligonucleotide
ugaaagucaucgacaagac

SEQ ID NO: 3222 - RNA, 19 nt, Artificial Sequence
  Synthetic Oligonucleotide
gaaagucaucgacaagaca

SEQ ID NO: 3223 - RNA, 19 nt, Artificial Sequence
  Synthetic Oligonucleotide
aaagucaucgacaagacau

SEQ ID NO: 3224 - RNA, 19 nt, Artificial Sequence
  Synthetic Oligonucleotide
aagucaucgacaagacauu

SEQ ID NO: 3225 - RNA, 19 nt, Artificial Sequence
  Synthetic Oligonucleotide
agucaucgacaagacauug

SEQ ID NO: 3226 - RNA, 19 nt, Artificial Sequence
  Synthetic Oligonucleotide
gucaucgacaagacauugg

SEQ ID NO: 3227 - RNA, 19 nt, Artificial Sequence
  Synthetic Oligonucleotide
ucaucgacaagacauuggu

SEQ ID NO: 3228 - RNA, 19 nt, Artificial Sequence
  Synthetic Oligonucleotide
caucgacaagacauuggug

SEQ ID NO: 3229 - RNA, 19 nt, Artificial Sequence
  Synthetic Oligonucleotide
aucgacaagacauugguga

SEQ ID NO: 3230 - RNA, 19 nt, Artificial Sequence
  Synthetic Oligonucleotide
ucgacaagacauuggugag

SEQ ID NO: 3231 - RNA, 19 nt, Artificial Sequence
  Synthetic Oligonucleotide
cgacaagacauuggugagg

SEQ ID NO: 3232 - RNA, 19 nt, Artificial Sequence
  Synthetic Oligonucleotide
gacaagacauuggugagga

SEQ ID NO: 3233 - RNA, 19 nt, Artificial Sequence
  Synthetic Oligonucleotide
acaagacauuggugaggaa

SEQ ID NO: 3234 - RNA, 19 nt, Artificial Sequence
  Synthetic Oligonucleotide
caagacauuggugaggaaa

SEQ ID NO: 3235 - RNA, 19 nt, Artificial Sequence
  Synthetic Oligonucleotide
aagacauuggugaggaaaa

SEQ ID NO: 3236 - RNA, 19 nt, Artificial Sequence
  Synthetic Oligonucleotide
agacauuggugaggaaaaa

SEQ ID NO: 3237 - RNA, 19 nt, Artificial Sequence
  Synthetic Oligonucleotide
gacauuggugaggaaaaau

SEQ ID NO: 3238 - RNA, 19 nt, Artificial Sequence
  Synthetic Oligonucleotide
acauuggugaggaaaaauc

SEQ ID NO: 3239 - RNA, 19 nt, Artificial Sequence
  Synthetic Oligonucleotide
cauuggugaggaaaaaucc

SEQ ID NO: 3240 - RNA, 19 nt, Artificial Sequence
  Synthetic Oligonucleotide
auuggugaggaaaaauccu

SEQ ID NO: 3241 - RNA, 19 nt, Artificial Sequence
  Synthetic Oligonucleotide
uuggugaggaaaaauccuu

SEQ ID NO: 3242 - RNA, 19 nt, Artificial Sequence
  Synthetic Oligonucleotide
uggugaggaaaaauccuuu

SEQ ID NO: 3243 - RNA, 19 nt, Artificial Sequence
  Synthetic Oligonucleotide
ggugaggaaaaauccuuug

SEQ ID NO: 3244 - RNA, 19 nt, Artificial Sequence
  Synthetic Oligonucleotide
ccguuuccaagaucugaca

SEQ ID NO: 3245 - RNA, 19 nt, Artificial Sequence
  Synthetic Oligonucleotide
cguuuccaagaucugacag

SEQ ID NO: 3246 - RNA, 19 nt, Artificial Sequence
  Synthetic Oligonucleotide
guuuccaagaucugacagu

SEQ ID NO: 3247 - RNA, 19 nt, Artificial Sequence
  Synthetic Oligonucleotide
uuuccaagaucugacagug

SEQ ID NO: 3248 - RNA, 19 nt, Artificial Sequence
  Synthetic Oligonucleotide
uuccaagaucugacagugc

SEQ ID NO: 3249 - RNA, 19 nt, Artificial Sequence
  Synthetic Oligonucleotide
uccaagaucugacagugca

SEQ ID NO: 3250 - RNA, 19 nt, Artificial Sequence
  Synthetic Oligonucleotide
ccaagaucugacagugcac

SEQ ID NO: 3251 - RNA, 19 nt, Artificial Sequence
  Synthetic Oligonucleotide
caagaucugacagugcaca

SEQ ID NO: 3252 - RNA, 19 nt, Artificial Sequence
  Synthetic Oligonucleotide
aagaucugacagugcacaa

SEQ ID NO: 3253 - RNA, 19 nt, Artificial Sequence
  Synthetic Oligonucleotide
agaucugacagugcacaau

SEQ ID NO: 3254 - RNA, 19 nt, Artificial Sequence
  Synthetic Oligonucleotide
gaucugacagugcacaaua

SEQ ID NO: 3255 - RNA, 19 nt, Artificial Sequence
  Synthetic Oligonucleotide
aucugacagugcacaauau

SEQ ID NO: 3256 - RNA, 19 nt, Artificial Sequence
  Synthetic Oligonucleotide
ucugacagugcacaauauu

SEQ ID NO: 3257 - RNA, 19 nt, Artificial Sequence
  Synthetic Oligonucleotide
cugacagugcacaauauuu

SEQ ID NO: 3258 - RNA, 19 nt, Artificial Sequence
  Synthetic Oligonucleotide
ugacagugcacaauauuuu

SEQ ID NO: 3259 - RNA, 19 nt, Artificial Sequence
  Synthetic Oligonucleotide
gacagugcacaauauuuuc

SEQ ID NO: 3260 - RNA, 19 nt, Artificial Sequence
  Synthetic Oligonucleotide
acagugcacaauauuuucc

SEQ ID NO: 3261 - RNA, 19 nt, Artificial Sequence
  Synthetic Oligonucleotide
cagugcacaauauuuuccc

SEQ ID NO: 3262 - RNA, 19 nt, Artificial Sequence
  Synthetic Oligonucleotide
agugcacaauauuuuccca

SEQ ID NO: 3263 - RNA, 19 nt, Artificial Sequence
  Synthetic Oligonucleotide
gugcacaauauuuucccau

SEQ ID NO: 3264 - RNA, 19 nt, Artificial Sequence
  Synthetic Oligonucleotide
ugcacaauauuuucccauc

SEQ ID NO: 3265 - RNA, 19 nt, Artificial Sequence
  Synthetic Oligonucleotide
gcacaauauuuucccaucu

SEQ ID NO: 3266 - RNA, 19 nt, Artificial Sequence
  Synthetic Oligonucleotide
cacaauauuuucccaucug

SEQ ID NO: 3267 - RNA, 19 nt, Artificial Sequence
  Synthetic Oligonucleotide
acaauauuuucccaucugu

SEQ ID NO: 3268 - RNA, 19 nt, Artificial Sequence
  Synthetic Oligonucleotide
caauauuuucccaucugua

SEQ ID NO: 3269 - RNA, 19 nt, Artificial Sequence
  Synthetic Oligonucleotide
aauauuuucccaucuguau

SEQ ID NO: 3270 - RNA, 19 nt, Artificial Sequence
  Synthetic Oligonucleotide
auauuuucccaucuguauu

SEQ ID NO: 3271 - RNA, 19 nt, Artificial Sequence
  Synthetic Oligonucleotide
uuuuuuucagcauguauua

SEQ ID NO: 3272 - RNA, 19 nt, Artificial Sequence
  Synthetic Oligonucleotide
uuuuuucagcauguauuac

SEQ ID NO: 3273 - RNA, 19 nt, Artificial Sequence
  Synthetic Oligonucleotide
uuuuucagcauguauuacu

SEQ ID NO: 3274 - RNA, 19 nt, Artificial Sequence
  Synthetic Oligonucleotide
uuuucagcauguauuacuu

SEQ ID NO: 3275 - RNA, 19 nt, Artificial Sequence
  Synthetic Oligonucleotide
uuucagcauguauuacuug

SEQ ID NO: 3276 - RNA, 19 nt, Artificial Sequence
  Synthetic Oligonucleotide
uucagcauguauuacuuga

SEQ ID NO: 3277 - RNA, 19 nt, Artificial Sequence
  Synthetic Oligonucleotide
ucagcauguauuacuugac

SEQ ID NO: 3278 - RNA, 19 nt, Artificial Sequence
  Synthetic Oligonucleotide
cagcauguauuacuugaca

SEQ ID NO: 3279 - RNA, 19 nt, Artificial Sequence
  Synthetic Oligonucleotide
agcauguauuacuugacaa

SEQ ID NO: 3280 - RNA, 19 nt, Artificial Sequence
  Synthetic Oligonucleotide
uguauuacuugacaaagag

SEQ ID NO: 3281 - RNA, 19 nt, Artificial Sequence
  Synthetic Oligonucleotide
guauuacuugacaaagaga

SEQ ID NO: 3282 - RNA, 19 nt, Artificial Sequence
  Synthetic Oligonucleotide
uauuacuugacaaagagac

SEQ ID NO: 3283 - RNA, 19 nt, Artificial Sequence
  Synthetic Oligonucleotide
auuacuugacaaagagaca

SEQ ID NO: 3284 - RNA, 19 nt, Artificial Sequence
  Synthetic Oligonucleotide
uuacuugacaaagagacac

SEQ ID NO: 3285 - RNA, 19 nt, Artificial Sequence
  Synthetic Oligonucleotide
uacuugacaaagagacacu

SEQ ID NO: 3286 - RNA, 19 nt, Artificial Sequence
  Synthetic Oligonucleotide
acuugacaaagagacacug

SEQ ID NO: 3287 - RNA, 19 nt, Artificial Sequence
  Synthetic Oligonucleotide
cuugacaaagagacacugu

SEQ ID NO: 3288 - RNA, 19 nt, Artificial Sequence
  Synthetic Oligonucleotide
uugacaaagagacacugug

SEQ ID NO: 3289 - RNA, 19 nt, Artificial Sequence
  Synthetic Oligonucleotide
ugacaaagagacacugugc

SEQ ID NO: 3290 - RNA, 19 nt, Artificial Sequence
  Synthetic Oligonucleotide
gacaaagagacacugugca

SEQ ID NO: 3291 - RNA, 19 nt, Artificial Sequence
  Synthetic Oligonucleotide
acaaagagacacugugcag

SEQ ID NO: 3292 - RNA, 19 nt, Artificial Sequence
  Synthetic Oligonucleotide
caaagagacacugugcaga

SEQ ID NO: 3293 - RNA, 19 nt, Artificial Sequence
  Synthetic Oligonucleotide
aaagagacacugugcagag

SEQ ID NO: 3294 - RNA, 19 nt, Artificial Sequence
  Synthetic Oligonucleotide
aagagacacugugcagagg

SEQ ID NO: 3295 - RNA, 19 nt, Artificial Sequence
  Synthetic Oligonucleotide
agagacacugugcagaggg

SEQ ID NO: 3296 - RNA, 19 nt, Artificial Sequence
  Synthetic Oligonucleotide
gagacacugugcagagggu

SEQ ID NO: 3297 - RNA, 19 nt, Artificial Sequence
  Synthetic Oligonucleotide
agacacugugcagagggug

SEQ ID NO: 3298 - RNA, 19 nt, Artificial Sequence
  Synthetic Oligonucleotide
gacacugugcagaggguga

SEQ ID NO: 3299 - RNA, 19 nt, Artificial Sequence
  Synthetic Oligonucleotide
acacugugcagagggugac

SEQ ID NO: 3300 - RNA, 19 nt, Artificial Sequence
  Synthetic Oligonucleotide
cacugugcagagggugacc

SEQ ID NO: 3301 - RNA, 19 nt, Artificial Sequence
  Synthetic Oligonucleotide
acugugcagagggugacca

SEQ ID NO: 3302 - RNA, 19 nt, Artificial Sequence
  Synthetic Oligonucleotide
cugugcagagggugaccac

SEQ ID NO: 3303 - RNA, 19 nt, Artificial Sequence
  Synthetic Oligonucleotide
cagucuguaauuccccacu

SEQ ID NO: 3304 - RNA, 19 nt, Artificial Sequence
  Synthetic Oligonucleotide
agucuguaauuccccacuu

SEQ ID NO: 3305 - RNA, 19 nt, Artificial Sequence
  Synthetic Oligonucleotide
gucuguaauuccccacuuc

SEQ ID NO: 3306 - RNA, 19 nt, Artificial Sequence
  Synthetic Oligonucleotide
ucuguaauuccccacuuca

SEQ ID NO: 3307 - RNA, 19 nt, Artificial Sequence
  Synthetic Oligonucleotide
caauacaaagggugucguu

SEQ ID NO: 3308 - RNA, 19 nt, Artificial Sequence
  Synthetic Oligonucleotide
aauacaaagggugucguuc

SEQ ID NO: 3309 - RNA, 19 nt, Artificial Sequence
  Synthetic Oligonucleotide
auacaaagggugucguucu

SEQ ID NO: 3310 - RNA, 19 nt, Artificial Sequence
  Synthetic Oligonucleotide
uacaaagggugucguucuu

SEQ ID NO: 3311 - RNA, 19 nt, Artificial Sequence
  Synthetic Oligonucleotide
acaaagggugucguucuuu

SEQ ID NO: 3312 - RNA, 19 nt, Artificial Sequence
  Synthetic Oligonucleotide
caaagggugucguucuuuu

SEQ ID NO: 3313 - RNA, 19 nt, Artificial Sequence
  Synthetic Oligonucleotide
aaagggugucguucuuuuc

SEQ ID NO: 3314 - RNA, 19 nt, Artificial Sequence
  Synthetic Oligonucleotide
aagggugucguucuuuucc

SEQ ID NO: 3315 - RNA, 19 nt, Artificial Sequence
  Synthetic Oligonucleotide
agggugucguucuuuucca

SEQ ID NO: 3316 - RNA, 19 nt, Artificial Sequence
  Synthetic Oligonucleotide
gggugucguucuuuuccaa

SEQ ID NO: 3317 - RNA, 19 nt, Artificial Sequence
  Synthetic Oligonucleotide
ggugucguucuuuuccaac

SEQ ID NO: 3318 - RNA, 19 nt, Artificial Sequence
  Synthetic Oligonucleotide
gugucguucuuuuccaaca

SEQ ID NO: 3319 - RNA, 19 nt, Artificial Sequence
  Synthetic Oligonucleotide
ugucguucuuuuccaacaa

SEQ ID NO: 3320 - RNA, 19 nt, Artificial Sequence
  Synthetic Oligonucleotide
gucguucuuuuccaacaaa

SEQ ID NO: 3321 - RNA, 19 nt, Artificial Sequence
  Synthetic Oligonucleotide
ucguucuuuuccaacaaaa

SEQ ID NO: 3322 - RNA, 19 nt, Artificial Sequence
  Synthetic Oligonucleotide
cguucuuuuccaacaaaau

SEQ ID NO: 3323 - RNA, 19 nt, Artificial Sequence
  Synthetic Oligonucleotide
guucuuuuccaacaaaaua

SEQ ID NO: 3324 - RNA, 19 nt, Artificial Sequence
  Synthetic Oligonucleotide
uccaacaaaauagcaaucc

SEQ ID NO: 3325 - RNA, 19 nt, Artificial Sequence
  Synthetic Oligonucleotide
ccaacaaaauagcaauccc

SEQ ID NO: 3326 - RNA, 19 nt, Artificial Sequence
  Synthetic Oligonucleotide
caacaaaauagcaaucccu

SEQ ID NO: 3327 - RNA, 19 nt, Artificial Sequence
  Synthetic Oligonucleotide
aacaaaauagcaaucccuu

SEQ ID NO: 3328 - RNA, 19 nt, Artificial Sequence
  Synthetic Oligonucleotide
acaaaauagcaaucccuuu

SEQ ID NO: 3329 - RNA, 19 nt, Artificial Sequence
  Synthetic Oligonucleotide
auuucauugcuuuugacuu

SEQ ID NO: 3330 - RNA, 19 nt, Artificial Sequence
  Synthetic Oligonucleotide
uuucauugcuuuugacuuu

SEQ ID NO: 3331 - RNA, 19 nt, Artificial Sequence
  Synthetic Oligonucleotide
uucauugcuuuugacuuuu

SEQ ID NO: 3332 - RNA, 19 nt, Artificial Sequence
  Synthetic Oligonucleotide
ucauugcuuuugacuuuuc

SEQ ID NO: 3333 - RNA, 19 nt, Artificial Sequence
  Synthetic Oligonucleotide
cauugcuuuugacuuuuca

SEQ ID NO: 3334 - RNA, 19 nt, Artificial Sequence
  Synthetic Oligonucleotide
auugcuuuugacuuuucaa

SEQ ID NO: 3335 - RNA, 19 nt, Artificial Sequence
  Synthetic Oligonucleotide
uugcuuuugacuuuucaau

SEQ ID NO: 3336 - RNA, 19 nt, Artificial Sequence
  Synthetic Oligonucleotide
ugcuuuugacuuuucaaug

SEQ ID NO: 3337 - RNA, 19 nt, Artificial Sequence
  Synthetic Oligonucleotide
gcuuuugacuuuucaaugg

SEQ ID NO: 3338 - RNA, 19 nt, Artificial Sequence
  Synthetic Oligonucleotide
cuuuugacuuuucaauggg

SEQ ID NO: 3339 - RNA, 19 nt, Artificial Sequence
  Synthetic Oligonucleotide
uuuugacuuuucaaugggu

SEQ ID NO: 3340 - RNA, 19 nt, Artificial Sequence
  Synthetic Oligonucleotide
uuugacuuuucaaugggug

SEQ ID NO: 3341 - RNA, 19 nt, Artificial Sequence
  Synthetic Oligonucleotide
uugacuuuucaaugggugu

SEQ ID NO: 3342 - RNA, 19 nt, Artificial Sequence
  Synthetic Oligonucleotide
ugacuuuucaauggguguc

SEQ ID NO: 3343 - RNA, 19 nt, Artificial Sequence
  Synthetic Oligonucleotide
gacuuuucaaugggugucc

SEQ ID NO: 3344 - RNA, 19 nt, Artificial Sequence
  Synthetic Oligonucleotide
acuuuucaauggguguccu

SEQ ID NO: 3345 - RNA, 19 nt, Artificial Sequence
  Synthetic Oligonucleotide
cuuuucaauggguguccua

SEQ ID NO: 3346 - RNA, 19 nt, Artificial Sequence
  Synthetic Oligonucleotide
uuuucaauggguguccuag

SEQ ID NO: 3347 - RNA, 19 nt, Artificial Sequence
  Synthetic Oligonucleotide
uuucaauggguguccuagg

SEQ ID NO: 3348 - RNA, 19 nt, Artificial Sequence
  Synthetic Oligonucleotide
uucaauggguguccuagga

SEQ ID NO: 3349 - RNA, 19 nt, Artificial Sequence
  Synthetic Oligonucleotide
ucaauggguguccuaggaa

SEQ ID NO: 3350 - RNA, 19 nt, Artificial Sequence
  Synthetic Oligonucleotide
caauggguguccuaggaac

SEQ ID NO: 3351 - RNA, 19 nt, Artificial Sequence
  Synthetic Oligonucleotide
aauggguguccuaggaacc

SEQ ID NO: 3352 - RNA, 19 nt, Artificial Sequence
  Synthetic Oligonucleotide
agaaauggacuuucauccu

SEQ ID NO: 3353 - RNA, 19 nt, Artificial Sequence
  Synthetic Oligonucleotide
gaaauggacuuucauccug

SEQ ID NO: 3354 - RNA, 19 nt, Artificial Sequence
  Synthetic Oligonucleotide
aaauggacuuucauccugg

SEQ ID NO: 3355 - RNA, 19 nt, Artificial Sequence
  Synthetic Oligonucleotide
aauggacuuucauccugga

SEQ ID NO: 3356 - RNA, 19 nt, Artificial Sequence
  Synthetic Oligonucleotide
auggacuuucauccuggaa

SEQ ID NO: 3357 - RNA, 19 nt, Artificial Sequence
  Synthetic Oligonucleotide
uggacuuucauccuggaaa

SEQ ID NO: 3358 - RNA, 19 nt, Artificial Sequence
  Synthetic Oligonucleotide
ggacuuucauccuggaaau

SEQ ID NO: 3359 - RNA, 19 nt, Artificial Sequence
  Synthetic Oligonucleotide
gacuuucauccuggaaaua

SEQ ID NO: 3360 - RNA, 19 nt, Artificial Sequence
  Synthetic Oligonucleotide
acuuucauccuggaaauau

SEQ ID NO: 3361 - RNA, 19 nt, Artificial Sequence
  Synthetic Oligonucleotide
cuuucauccuggaaauaua

SEQ ID NO: 3362 - RNA, 19 nt, Artificial Sequence
  Synthetic Oligonucleotide
uuucauccuggaaauauau

SEQ ID NO: 3363 - RNA, 19 nt, Artificial Sequence
  Synthetic Oligonucleotide
uucauccuggaaauauauu

SEQ ID NO: 3364 - RNA, 19 nt, Artificial Sequence
  Synthetic Oligonucleotide
ucauccuggaaauauauua

SEQ ID NO: 3365 - RNA, 19 nt, Artificial Sequence
  Synthetic Oligonucleotide
cauccuggaaauauauuaa

SEQ ID NO: 3366 - RNA, 19 nt, Artificial Sequence
  Synthetic Oligonucleotide
auccuggaaauauauuaac

SEQ ID NO: 3367 - RNA, 19 nt, Artificial Sequence
  Synthetic Oligonucleotide
uccuggaaauauauuaacu

SEQ ID NO: 3368 - RNA, 19 nt, Artificial Sequence
  Synthetic Oligonucleotide
ccuggaaauauauuaacug

SEQ ID NO: 3369 - RNA, 19 nt, Artificial Sequence
  Synthetic Oligonucleotide
cuggaaauauauuaacugu

SEQ ID NO: 3370 - RNA, 19 nt, Artificial Sequence
  Synthetic Oligonucleotide
uggaaauauauuaacuguu

SEQ ID NO: 3371 - RNA, 19 nt, Artificial Sequence
  Synthetic Oligonucleotide
ggaaauauauuaacuguua

SEQ ID NO: 3372 - RNA, 19 nt, Artificial Sequence
  Synthetic Oligonucleotide
gaaauauauuaacuguuaa

SEQ ID NO: 3373 - RNA, 19 nt, Artificial Sequence
  Synthetic Oligonucleotide
aaauauauuaacuguuaaa

SEQ ID NO: 3374 - RNA, 19 nt, Artificial Sequence
  Synthetic Oligonucleotide
aauauauuaacuguuaaaa

SEQ ID NO: 3375 - RNA, 19 nt, Artificial Sequence
  Synthetic Oligonucleotide
auauauuaacuguuaaaaa

SEQ ID NO: 3376 - RNA, 19 nt, Artificial Sequence
  Synthetic Oligonucleotide
uauauuaacuguuaaaaag

SEQ ID NO: 3377 - RNA, 19 nt, Artificial Sequence
  Synthetic Oligonucleotide
auauuaacuguuaaaaaga

SEQ ID NO: 3378 - RNA, 19 nt, Artificial Sequence
  Synthetic Oligonucleotide
uauuaacuguuaaaaagaa

SEQ ID NO: 3379 - RNA, 19 nt, Artificial Sequence
  Synthetic Oligonucleotide
auuaacuguuaaaaagaaa

SEQ ID NO: 3380 - RNA, 19 nt, Artificial Sequence
  Synthetic Oligonucleotide
uuaacuguuaaaaagaaaa

SEQ ID NO: 3381 - RNA, 19 nt, Artificial Sequence
  Synthetic Oligonucleotide
uaacuguuaaaaagaaaac

SEQ ID NO: 3382 - RNA, 19 nt, Artificial Sequence
  Synthetic Oligonucleotide
aacuguuaaaaagaaaaca

SEQ ID NO: 3383 - RNA, 19 nt, Artificial Sequence
  Synthetic Oligonucleotide
acuguuaaaaagaaaacau

SEQ ID NO: 3384 - RNA, 19 nt, Artificial Sequence
  Synthetic Oligonucleotide
cuguuaaaaagaaaacauu

SEQ ID NO: 3385 - RNA, 19 nt, Artificial Sequence
  Synthetic Oligonucleotide
uguuaaaaagaaaacauug

SEQ ID NO: 3386 - RNA, 19 nt, Artificial Sequence
  Synthetic Oligonucleotide
gacaacgucauccccuggc

SEQ ID NO: 3387 - RNA, 19 nt, Artificial Sequence
  Synthetic Oligonucleotide
acaacgucauccccuggca

SEQ ID NO: 3388 - RNA, 19 nt, Artificial Sequence
  Synthetic Oligonucleotide
caacgucauccccuggcag

SEQ ID NO: 3389 - RNA, 19 nt, Artificial Sequence
  Synthetic Oligonucleotide
aacgucauccccuggcagg

SEQ ID NO: 3390 - RNA, 19 nt, Artificial Sequence
  Synthetic Oligonucleotide
acgucauccccuggcaggc

SEQ ID NO: 3391 - RNA, 19 nt, Artificial Sequence
  Synthetic Oligonucleotide
cgucauccccuggcaggcu

SEQ ID NO: 3392 - RNA, 19 nt, Artificial Sequence
  Synthetic Oligonucleotide
gucauccccuggcaggcua

SEQ ID NO: 3393 - RNA, 19 nt, Artificial Sequence
  Synthetic Oligonucleotide
ucauccccuggcaggcuaa

SEQ ID NO: 3394 - RNA, 19 nt, Artificial Sequence
  Synthetic Oligonucleotide
cauccccuggcaggcuaaa

SEQ ID NO: 3395 - RNA, 19 nt, Artificial Sequence
  Synthetic Oligonucleotide
auccccuggcaggcuaaag

SEQ ID NO: 3396 - RNA, 19 nt, Artificial Sequence
  Synthetic Oligonucleotide
uccccuggcaggcuaaagu

SEQ ID NO: 3397 - RNA, 19 nt, Artificial Sequence
  Synthetic Oligonucleotide
ccccuggcaggcuaaagug

SEQ ID NO: 3398 - RNA, 19 nt, Artificial Sequence
  Synthetic Oligonucleotide
cccuggcaggcuaaagugc

SEQ ID NO: 3399 - RNA, 19 nt, Artificial Sequence
  Synthetic Oligonucleotide
agguagcaaacacuaaggu

SEQ ID NO: 3400 - RNA, 19 nt, Artificial Sequence
  Synthetic Oligonucleotide
gguagcaaacacuaaggug

SEQ ID NO: 3401 - RNA, 19 nt, Artificial Sequence
  Synthetic Oligonucleotide
guagcaaacacuaagguga

SEQ ID NO: 3402 - RNA, 19 nt, Artificial Sequence
  Synthetic Oligonucleotide
uagcaaacacuaaggugaa

SEQ ID NO: 3403 - RNA, 19 nt, Artificial Sequence
  Synthetic Oligonucleotide
gcaaacacuaaggugaaaa

SEQ ID NO: 3404 - RNA, 19 nt, Artificial Sequence
  Synthetic Oligonucleotide
caaacacuaaggugaaaag

SEQ ID NO: 3405 - RNA, 19 nt, Artificial Sequence
  Synthetic Oligonucleotide
cacuaaggugaaaagauaa

SEQ ID NO: 3406 - RNA, 19 nt, Artificial Sequence
  Synthetic Oligonucleotide
acuaaggugaaaagauaau

SEQ ID NO: 3407 - RNA, 19 nt, Artificial Sequence
  Synthetic Oligonucleotide
cuaaggugaaaagauaaug

SEQ ID NO: 3408 - RNA, 19 nt, Artificial Sequence
  Synthetic Oligonucleotide
uaaggugaaaagauaauga

SEQ ID NO: 3409 - RNA, 19 nt, Artificial Sequence
  Synthetic Oligonucleotide
aaggugaaaagauaaugau

SEQ ID NO: 3410 - RNA, 19 nt, Artificial Sequence
  Synthetic Oligonucleotide
aggugaaaagauaaugauc

SEQ ID NO: 3411 - RNA, 19 nt, Artificial Sequence
  Synthetic Oligonucleotide
ggugaaaagauaaugaucu

SEQ ID NO: 3412 - RNA, 19 nt, Artificial Sequence
  Synthetic Oligonucleotide
gugaaaagauaaugaucuc

SEQ ID NO: 3413 - RNA, 19 nt, Artificial Sequence
  Synthetic Oligonucleotide
ugaaaagauaaugaucuca

SEQ ID NO: 3414 - RNA, 19 nt, Artificial Sequence
  Synthetic Oligonucleotide
gaaaagauaaugaucucau

SEQ ID NO: 3415 - RNA, 19 nt, Artificial Sequence
  Synthetic Oligonucleotide
aaaagauaaugaucucauu

SEQ ID NO: 3416 - RNA, 19 nt, Artificial Sequence
  Synthetic Oligonucleotide
aaagauaaugaucucauug

SEQ ID NO: 3417 - RNA, 19 nt, Artificial Sequence
  Synthetic Oligonucleotide
aagauaaugaucucauugu

SEQ ID NO: 3418 - RNA, 19 nt, Artificial Sequence
  Synthetic Oligonucleotide
agauaaugaucucauuguu

SEQ ID NO: 3419 - RNA, 19 nt, Artificial Sequence
  Synthetic Oligonucleotide
gauaaugaucucauuguuu

SEQ ID NO: 3420 - RNA, 19 nt, Artificial Sequence
  Synthetic Oligonucleotide
auaaugaucucauuguuua

SEQ ID NO: 3421 - RNA, 19 nt, Artificial Sequence
  Synthetic Oligonucleotide
uaaugaucucauuguuuau

SEQ ID NO: 3422 - RNA, 19 nt, Artificial Sequence
  Synthetic Oligonucleotide
aaugaucucauuguuuauu

SEQ ID NO: 3423 - RNA, 19 nt, Artificial Sequence
  Synthetic Oligonucleotide
augaucucauuguuuauua

SEQ ID NO: 3424 - RNA, 19 nt, Artificial Sequence
  Synthetic Oligonucleotide
ugaucucauuguuuauuaa

SEQ ID NO: 3425 - RNA, 19 nt, Artificial Sequence
  Synthetic Oligonucleotide
gaucucauuguuuauuaac

SEQ ID NO: 3426 - RNA, 19 nt, Artificial Sequence
  Synthetic Oligonucleotide
aucucauuguuuauuaacc

SEQ ID NO: 3427 - RNA, 19 nt, Artificial Sequence
  Synthetic Oligonucleotide
ucucauuguuuauuaaccu

SEQ ID NO: 3428 - RNA, 19 nt, Artificial Sequence
  Synthetic Oligonucleotide
cucauuguuuauuaaccug

SEQ ID NO: 3429 - RNA, 19 nt, Artificial Sequence
  Synthetic Oligonucleotide
ucauuguuuauuaaccugu

SEQ ID NO: 3430 - RNA, 19 nt, Artificial Sequence
  Synthetic Oligonucleotide
uuguuuauuaaccuguauu

SEQ ID NO: 3431 - RNA, 19 nt, Artificial Sequence
  Synthetic Oligonucleotide
uguuuauuaaccuguauuc

SEQ ID NO: 3432 - RNA, 19 nt, Artificial Sequence
  Synthetic Oligonucleotide
uuauuaaccuguauucugu

SEQ ID NO: 3433 - RNA, 19 nt, Artificial Sequence
  Synthetic Oligonucleotide
uauuaaccuguauucuguu

SEQ ID NO: 3434 - RNA, 19 nt, Artificial Sequence
  Synthetic Oligonucleotide
cuuuaaaacagugguucuu

SEQ ID NO: 3435 - RNA, 19 nt, Artificial Sequence
  Synthetic Oligonucleotide
uuuaaaacagugguucuua

SEQ ID NO: 3436 - RNA, 19 nt, Artificial Sequence
  Synthetic Oligonucleotide
uuaaaacagugguucuuaa

SEQ ID NO: 3437 - RNA, 19 nt, Artificial Sequence
  Synthetic Oligonucleotide
uaaaacagugguucuuaaa

SEQ ID NO: 3438 - RNA, 19 nt, Artificial Sequence
  Synthetic Oligonucleotide
aaaacagugguucuuaaau

SEQ ID NO: 3439 - RNA, 19 nt, Artificial Sequence
  Synthetic Oligonucleotide
aaacagugguucuuaaauu

SEQ ID NO: 3440 - RNA, 19 nt, Artificial Sequence
  Synthetic Oligonucleotide
aacagugguucuuaaauug

SEQ ID NO: 3441 - RNA, 19 nt, Artificial Sequence
  Synthetic Oligonucleotide
ugguucuuaaauuguaagc

SEQ ID NO: 3442 - RNA, 19 nt, Artificial Sequence
  Synthetic Oligonucleotide
uucuuaaauuguaagcuca

SEQ ID NO: 3443 - RNA, 19 nt, Artificial Sequence
  Synthetic Oligonucleotide
ucuuaaauuguaagcucag

SEQ ID NO: 3444 - RNA, 19 nt, Artificial Sequence
  Synthetic Oligonucleotide
uuaaauuguaagcucaggu

SEQ ID NO: 3445 - RNA, 19 nt, Artificial Sequence
  Synthetic Oligonucleotide
uaaauuguaagcucagguu

SEQ ID NO: 3446 - RNA, 19 nt, Artificial Sequence
  Synthetic Oligonucleotide
aaauuguaagcucagguuc

SEQ ID NO: 3447 - RNA, 19 nt, Artificial Sequence
  Synthetic Oligonucleotide
uuggugauacuucuuugaa

SEQ ID NO: 3448 - RNA, 19 nt, Artificial Sequence
  Synthetic Oligonucleotide
caaucacaucuuuaguguc

SEQ ID NO: 3449 - RNA, 19 nt, Artificial Sequence
  Synthetic Oligonucleotide
uuuagugucugaauauauc

SEQ ID NO: 3450 - RNA, 19 nt, Artificial Sequence
  Synthetic Oligonucleotide
uuagugucugaauauaucc

SEQ ID NO: 3451 - RNA, 19 nt, Artificial Sequence
  Synthetic Oligonucleotide
uagugucugaauauaucca

SEQ ID NO: 3452 - RNA, 19 nt, Artificial Sequence
  Synthetic Oligonucleotide
gugucugaauauauccaaa

SEQ ID NO: 3453 - RNA, 19 nt, Artificial Sequence
  Synthetic Oligonucleotide
ugucugaauauauccaaau

SEQ ID NO: 3454 - RNA, 19 nt, Artificial Sequence
  Synthetic Oligonucleotide
gucugaauauauccaaaug

SEQ ID NO: 3455 - RNA, 19 nt, Artificial Sequence
  Synthetic Oligonucleotide
ucugaauauauccaaaugu

SEQ ID NO: 3456 - RNA, 19 nt, Artificial Sequence
  Synthetic Oligonucleotide
cugaauauauccaaauguu

SEQ ID NO: 3457 - RNA, 21 nt, Artificial Sequence
  Synthetic Oligonucleotide
aauacagaugggaaaauauug

SEQ ID NO: 3458 - RNA, 27 nt, Artificial Sequence
  Synthetic Oligonucleotide
caauauuuucccaucuguauuauuucc

SEQ ID NO: 3459 - RNA, 21 nt, Artificial Sequence
  Synthetic Oligonucleotide
caauauuuucccaucuguacc

SEQ ID NO: 3460 - DNA, 25 bp, Artificial Sequence
  Synthetic Oligonucleotide
auauuuucccaucuguauaauuutt

SEQ ID NO: 3461 - DNA, 25 bp, Artificial Sequence
  Synthetic Oligonucleotide
auauuuucccaucuguauuuuuutt

SEQ ID NO: 3462 - DNA, 25 bp, Artificial Sequence
  Synthetic Oligonucleotide
auauuuucccaucuguauuaauutt

SEQ ID NO: 3463 - DNA, 25 bp, Artificial Sequence
  Synthetic Oligonucleotide
auauuuucccaucuguauuaugutt

SEQ ID NO: 3464 - DNA, 25 bp, Artificial Sequence
  Synthetic Oligonucleotide
auauuuucccaucuguauuauuatt

SEQ ID NO: 3465 - DNA, 25 bp, Artificial Sequence
  Synthetic Oligonucleotide
auauuuucccaucuguauuauuugt

SEQ ID NO: 3466 - DNA, 25 bp, Artificial Sequence
  Synthetic Oligonucleotide
auauuuucccaucuguauuauuuta

SEQ ID NO: 3467 - RNA, 27 nt, Artificial Sequence
  Synthetic Oligonucleotide
uaaaauaauacagaugggaaaauauug

SEQ ID NO: 3468 - RNA, 27 nt, Artificial Sequence
  Synthetic Oligonucleotide
acaaauaauacagaugggaaaauauug

SEQ ID NO: 3469 - RNA, 27 nt, Artificial Sequence
  Synthetic Oligonucleotide
aauaauaauacagaugggaaaauauug

SEQ ID NO: 3470 - RNA, 27 nt, Artificial Sequence
  Synthetic Oligonucleotide
aaacauaauacagaugggaaaauauug

SEQ ID NO: 3471 - RNA, 27 nt, Artificial Sequence
  Synthetic Oligonucleotide
aaaauuaauacagaugggaaaauauug

SEQ ID NO: 3472 - RNA, 27 nt, Artificial Sequence
  Synthetic Oligonucleotide
aaaaaaaauacagaugggaaaauauug

SEQ ID NO: 3473 - RNA, 27 nt, Artificial Sequence
  Synthetic Oligonucleotide
aaaaauuauacagaugggaaaauauug

SEQ ID NO: 3474 - DNA, 25 bp, Artificial Sequence
  Synthetic Oligonucleotide
uggaaauauauuaacuguaaaaaag

SEQ ID NO: 3475 - DNA, 25 bp, Artificial Sequence
  Synthetic Oligonucleotide
uggaaauauauuaacuguuuaaaag

SEQ ID NO: 3476 - DNA, 25 bp, Artificial Sequence
  Synthetic Oligonucleotide
uggaaauauauuaacuguuauaaag

SEQ ID NO: 3477 - DNA, 25 bp, Artificial Sequence
  Synthetic Oligonucleotide
uggaaauauauuaacuguuaagaag

SEQ ID NO: 3478 - DNA, 25 bp, Artificial Sequence
  Synthetic Oligonucleotide
uggaaauauauuaacuguuaaauag

SEQ ID NO: 3479 - DNA, 25 bp, Artificial Sequence
  Synthetic Oligonucleotide
uggaaauauauuaacuguuaaaagg

SEQ ID NO: 3480 - DNA, 25 bp, Artificial Sequence
  Synthetic Oligonucleotide
uggaaauauauuaacuguuaaaaaa

SEQ ID NO: 3481 - RNA, 27 nt, Artificial Sequence
  Synthetic Oligonucleotide
uuuuuuaacaguuaauauauuuccagg

SEQ ID NO: 3482 - RNA, 27 nt, Artificial Sequence
  Synthetic Oligonucleotide
ccuuuuaacaguuaauauauuuccagg

SEQ ID NO: 3483 - RNA, 27 nt, Artificial Sequence
  Synthetic Oligonucleotide
cuauuuaacaguuaauauauuuccagg

SEQ ID NO: 3484 - RNA, 27 nt, Artificial Sequence
  Synthetic Oligonucleotide
cuucuuaacaguuaauauauuuccagg

SEQ ID NO: 3485 - RNA, 27 nt, Artificial Sequence
  Synthetic Oligonucleotide
cuuuauaacaguuaauauauuuccagg

SEQ ID NO: 3486 - RNA, 27 nt, Artificial Sequence
  Synthetic Oligonucleotide
cuuuuaaacaguuaauauauuuccagg

SEQ ID NO: 3487 - RNA, 27 nt, Artificial Sequence
  Synthetic Oligonucleotide
cuuuuuuacaguuaauauauuuccagg

SEQ ID NO: 3488 - DNA, 25 bp, Artificial Sequence
  Synthetic Oligonucleotide
  misc_feature (19)..(25): n is a, c, g, t or u
auauuuucccaucuguaunnnnnnn

SEQ ID NO: 3489 - RNA, 27 nt, Artificial Sequence
  Synthetic Oligonucleotide
  misc_feature (1)..(7): n is a, c, g, or u
nnnnnnnauacagaugggaaaauauug

SEQ ID NO: 3490 - RNA, 27 nt, Artificial Sequence
  Synthetic Oligonucleotide
  misc_feature (21)..(27): n is a, c, g, or u
caauauuuucccaucuguaunnnnnnn

SEQ ID NO: 3491 - DNA, 30 bp, Artificial Sequence
  Synthetic Oligonucleotide
tttcattgcttttgacttttcaatgggtgt

SEQ ID NO: 3492 - DNA, 25 bp, Artificial Sequence
  Synthetic Oligonucleotide
ggaaauauauuaacuguuaaaaaga

SEQ ID NO: 3493 - DNA, 25 bp, Artificial Sequence
  Synthetic Oligonucleotide
augaucucauuguuuauuaaccugt

SEQ ID NO: 3494 - DNA, 25 bp, Artificial Sequence
  Synthetic Oligonucleotide
gauaaugaucucauuguuuauuaac

SEQ ID NO: 3495 - DNA, 25 bp, Artificial Sequence
  Synthetic Oligonucleotide
gaaauauauuaacuguuaaaaagaa

SEQ ID NO: 3496 - DNA, 25 bp, Artificial Sequence
  Synthetic Oligonucleotide
cagcauguauuacuugacaaagaga

SEQ ID NO: 3497 - DNA, 25 bp, Artificial Sequence
  Synthetic Oligonucleotide
cuggaaauauauuaacuguuaaaaa

SEQ ID NO: 3498 - DNA, 25 bp, Artificial Sequence
  Synthetic Oligonucleotide
agauaaugaucucauuguuuauuaa

SEQ ID NO: 3499 - DNA, 25 bp, Artificial Sequence
  Synthetic Oligonucleotide
auuuugaaaccaguacuuuaucatt

SEQ ID NO: 3500 - DNA, 25 bp, Artificial Sequence
  Synthetic Oligonucleotide
gaaaccaguacuuuaucauuuuctc

SEQ ID NO: 3501 - DNA, 25 bp, Artificial Sequence
  Synthetic Oligonucleotide
uggaaauauauuaacuguuaaaaag

SEQ ID NO: 3502 - DNA, 25 bp, Artificial Sequence
  Synthetic Oligonucleotide
caaaauagcaaucccuuuuauuuca

SEQ ID NO: 3503 - DNA, 25 bp, Artificial Sequence
  Synthetic Oligonucleotide
aaugaucucauuguuuauuaacctg

SEQ ID NO: 3504 - DNA, 25 bp, Artificial Sequence
  Synthetic Oligonucleotide
cagugguucuuaaauuguaagcuca

SEQ ID NO: 3505 - DNA, 25 bp, Artificial Sequence
  Synthetic Oligonucleotide
acuuucauccuggaaauauauuaac

SEQ ID NO: 3506 - DNA, 25 bp, Artificial Sequence
  Synthetic Oligonucleotide
augaacaacaugcuaaaucaguact

SEQ ID NO: 3507 - DNA, 25 bp, Artificial Sequence
  Synthetic Oligonucleotide
gaaaagauaaugaucucauuguuta

SEQ ID NO: 3508 - DNA, 25 bp, Artificial Sequence
  Synthetic Oligonucleotide
gugauacuucuuugaauguagautt

SEQ ID NO: 3509 - DNA, 25 bp, Artificial Sequence
  Synthetic Oligonucleotide
aagacugacaucauugccaauugtt

SEQ ID NO: 3510 - DNA, 25 bp, Artificial Sequence
  Synthetic Oligonucleotide
gacuuucauccuggaaauauauuaa

SEQ ID NO: 3511 - DNA, 25 bp, Artificial Sequence
  Synthetic Oligonucleotide
auccuggaaauauauuaacuguuaa

SEQ ID NO: 3512 - DNA, 25 bp, Artificial Sequence
  Synthetic Oligonucleotide
gaagacugacaucauugccaauugt

SEQ ID NO: 3513 - DNA, 25 bp, Artificial Sequence
  Synthetic Oligonucleotide
uuggugauacuucuuugaauguaga

SEQ ID NO: 3514 - DNA, 25 bp, Artificial Sequence
  Synthetic Oligonucleotide
cauuguuuauuaaccuguauucugt

SEQ ID NO: 3515 - DNA, 25 bp, Artificial Sequence
  Synthetic Oligonucleotide
gugaaaagauaaugaucucauugtt

SEQ ID NO: 3516 - DNA, 25 bp, Artificial Sequence
  Synthetic Oligonucleotide
ucauccuggaaauauauuaacugtt

SEQ ID NO: 3517 - DNA, 25 bp, Artificial Sequence
  Synthetic Oligonucleotide
aaaauagcaaucccuuuuauuucat

SEQ ID NO: 3518 - DNA, 25 bp, Artificial Sequence
  Synthetic Oligonucleotide
auaaugaucucauuguuuauuaacc

SEQ ID NO: 3519 - DNA, 25 bp, Artificial Sequence
  Synthetic Oligonucleotide
uucauccuggaaauauauuaacugt

SEQ ID NO: 3520 - DNA, 25 bp, Artificial Sequence
  Synthetic Oligonucleotide
gcaaucccuuuuauuucauugcutt

SEQ ID NO: 3521 - DNA, 25 bp, Artificial Sequence
  Synthetic Oligonucleotide
aaauagcaaucccuuuuauuucatt

SEQ ID NO: 3522 - DNA, 25 bp, Artificial Sequence
  Synthetic Oligonucleotide
agcauguauuacuugacaaagagac

SEQ ID NO: 3523 - DNA, 25 bp, Artificial Sequence
  Synthetic Oligonucleotide
aauuggugauacuucuuugaaugta

SEQ ID NO: 3524 - DNA, 25 bp, Artificial Sequence
  Synthetic Oligonucleotide
gauagcaauaaccugugaaaaugct

SEQ ID NO: 3525 - DNA, 25 bp, Artificial Sequence
  Synthetic Oligonucleotide
auuguuuauuaaccuguauucugtt

SEQ ID NO: 3526 - DNA, 25 bp, Artificial Sequence
  Synthetic Oligonucleotide
caacucaggaugaaaaauuuugaaa

SEQ ID NO: 3527 - DNA, 25 bp, Artificial Sequence
  Synthetic Oligonucleotide
cauccuggaaauauauuaacuguta

SEQ ID NO: 3528 - DNA, 25 bp, Artificial Sequence
  Synthetic Oligonucleotide
ggauagcaauaaccugugaaaaugc

SEQ ID NO: 3529 - DNA, 25 bp, Artificial Sequence
  Synthetic Oligonucleotide
auuggugauacuucuuugaauguag

SEQ ID NO: 3530 - DNA, 25 bp, Artificial Sequence
  Synthetic Oligonucleotide
gaaaaauuuugaaaccaguacuuta

SEQ ID NO: 3531 - DNA, 25 bp, Artificial Sequence
  Synthetic Oligonucleotide
uuuguaucaaugauuaugaacaaca

SEQ ID NO: 3532 - DNA, 25 bp, Artificial Sequence
  Synthetic Oligonucleotide
cuaauuuguaucaaugauuaugaac

SEQ ID NO: 3533 - DNA, 25 bp, Artificial Sequence
  Synthetic Oligonucleotide
cugaauauauccaaauguuuuagga

SEQ ID NO: 3534 - DNA, 25 bp, Artificial Sequence
  Synthetic Oligonucleotide
acagugguucuuaaauuguaagctc

SEQ ID NO: 3535 - DNA, 25 bp, Artificial Sequence
  Synthetic Oligonucleotide
aucucauuguuuauuaaccuguatt

SEQ ID NO: 3536 - DNA, 25 bp, Artificial Sequence
  Synthetic Oligonucleotide
ucauuguuuauuaaccuguauuctg

SEQ ID NO: 3537 - DNA, 25 bp, Artificial Sequence
  Synthetic Oligonucleotide
uuuuucagcauguauuacuugacaa

SEQ ID NO: 3538 - DNA, 25 bp, Artificial Sequence
  Synthetic Oligonucleotide
ccaguacuuuaucauuuucuccuga

SEQ ID NO: 3539 - DNA, 25 bp, Artificial Sequence
  Synthetic Oligonucleotide
aaugccugauucacaacuuugagaa

SEQ ID NO: 3540 - DNA, 25 bp, Artificial Sequence
  Synthetic Oligonucleotide
aauuuugaaaccaguacuuuaucat

SEQ ID NO: 3541 - DNA, 25 bp, Artificial Sequence
  Synthetic Oligonucleotide
agcaaucccuuuuauuucauugctt

SEQ ID NO: 3542 - DNA, 25 bp, Artificial Sequence
  Synthetic Oligonucleotide
gcuaauuuguaucaaugauuaugaa

SEQ ID NO: 3543 - DNA, 25 bp, Artificial Sequence
  Synthetic Oligonucleotide
ccuggaaauauauuaacuguuaaaa

SEQ ID NO: 3544 - DNA, 25 bp, Artificial Sequence
  Synthetic Oligonucleotide
aagauaaugaucucauuguuuauta

SEQ ID NO: 3545 - DNA, 25 bp, Artificial Sequence
  Synthetic Oligonucleotide
gaauauauccaaauguuuuaggatg

SEQ ID NO: 3546 - DNA, 25 bp, Artificial Sequence
  Synthetic Oligonucleotide
auuuguaucaaugauuaugaacaac

SEQ ID NO: 3547 - DNA, 25 bp, Artificial Sequence
  Synthetic Oligonucleotide
ugacaucauugccaauuguugcaaa

SEQ ID NO: 3548 - DNA, 25 bp, Artificial Sequence
  Synthetic Oligonucleotide
ugauuaugaacaacaugcuaaauca

SEQ ID NO: 3549 - DNA, 25 bp, Artificial Sequence
  Synthetic Oligonucleotide
aauagcaaucccuuuuauuucautg

SEQ ID NO: 3550 - DNA, 25 bp, Artificial Sequence
  Synthetic Oligonucleotide
auagcaauaaccugugaaaaugctc

SEQ ID NO: 3551 - DNA, 25 bp, Artificial Sequence
  Synthetic Oligonucleotide
uaauuuguaucaaugauuaugaaca

SEQ ID NO: 3552 - DNA, 25 bp, Artificial Sequence
  Synthetic Oligonucleotide
aacaacaugcuaaaucaguacuucc

SEQ ID NO: 3553 - DNA, 25 bp, Artificial Sequence
  Synthetic Oligonucleotide
auuucauugcuuuugacuuuucaat

SEQ ID NO: 3554 - DNA, 25 bp, Artificial Sequence
  Synthetic Oligonucleotide
auuguaagcucagguucaaagugtt

SEQ ID NO: 3555 - DNA, 25 bp, Artificial Sequence
  Synthetic Oligonucleotide
cugacaucauugccaauuguugcaa

SEQ ID NO: 3556 - DNA, 25 bp, Artificial Sequence
  Synthetic Oligonucleotide
ugaucucauuguuuauuaaccugta

SEQ ID NO: 3557 - DNA, 25 bp, Artificial Sequence
  Synthetic Oligonucleotide
auuaugaacaacaugcuaaaucagt

SEQ ID NO: 3558 - DNA, 25 bp, Artificial Sequence
  Synthetic Oligonucleotide
auggacuuucauccuggaaauauat

SEQ ID NO: 3559 - DNA, 25 bp, Artificial Sequence
  Synthetic Oligonucleotide
aguguugguaaugccugauucacaa

SEQ ID NO: 3560 - DNA, 25 bp, Artificial Sequence
  Synthetic Oligonucleotide
guaucaaugauuaugaacaacaugc

SEQ ID NO: 3561 - DNA, 25 bp, Artificial Sequence
  Synthetic Oligonucleotide
aucccuuuuauuucauugcuuuuga

SEQ ID NO: 3562 - DNA, 25 bp, Artificial Sequence
  Synthetic Oligonucleotide
guaauuggugauacuucuuugaatg

SEQ ID NO: 3563 - DNA, 25 bp, Artificial Sequence
  Synthetic Oligonucleotide
gacaagacauuggugaggaaaaatc

SEQ ID NO: 3564 - DNA, 25 bp, Artificial Sequence
  Synthetic Oligonucleotide
uagcaaucccuuuuauuucauugct

SEQ ID NO: 3565 - DNA, 25 bp, Artificial Sequence
  Synthetic Oligonucleotide
uugguaaugccugauucacaacutt

SEQ ID NO: 3566 - DNA, 25 bp, Artificial Sequence
  Synthetic Oligonucleotide
auuaacuguuaaaaagaaaacautg

SEQ ID NO: 3567 - DNA, 25 bp, Artificial Sequence
  Synthetic Oligonucleotide
caggaugaaaaauuuugaaaccagt

SEQ ID NO: 3568 - DNA, 25 bp, Artificial Sequence
  Synthetic Oligonucleotide
gggauagcaauaaccugugaaaatg

SEQ ID NO: 3569 - DNA, 25 bp, Artificial Sequence
  Synthetic Oligonucleotide
aaauuuugaaaccaguacuuuauca

SEQ ID NO: 3570 - DNA, 25 bp, Artificial Sequence
  Synthetic Oligonucleotide
ggugauacuucuuugaauguagatt

SEQ ID NO: 3571 - DNA, 25 bp, Artificial Sequence
  Synthetic Oligonucleotide
ucaaugauuaugaacaacaugcuaa

SEQ ID NO: 3572 - DNA, 25 bp, Artificial Sequence
  Synthetic Oligonucleotide
aagcucagguucaaaguguugguaa

SEQ ID NO: 3573 - DNA, 25 bp, Artificial Sequence
  Synthetic Oligonucleotide
aauuuguaucaaugauuaugaacaa

SEQ ID NO: 3574 - DNA, 25 bp, Artificial Sequence
  Synthetic Oligonucleotide
uuucauugcuuuugacuuuucaatg

SEQ ID NO: 3575 - DNA, 25 bp, Artificial Sequence
  Synthetic Oligonucleotide
ugaauauauccaaauguuuuaggat

SEQ ID NO: 3576 - DNA, 25 bp, Artificial Sequence
  Synthetic Oligonucleotide
gauuaugaacaacaugcuaaaucag

SEQ ID NO: 3577 - DNA, 25 bp, Artificial Sequence
  Synthetic Oligonucleotide
auauuaacuguuaaaaagaaaacat

SEQ ID NO: 3578 - DNA, 25 bp, Artificial Sequence
  Synthetic Oligonucleotide
ugguaaugccugauucacaacuutg

SEQ ID NO: 3579 - DNA, 25 bp, Artificial Sequence
  Synthetic Oligonucleotide
gaugaaaaauuuugaaaccaguact

SEQ ID NO: 3580 - DNA, 25 bp, Artificial Sequence
  Synthetic Oligonucleotide
uugaaaccaguacuuuaucauuutc

SEQ ID NO: 3581 - DNA, 25 bp, Artificial Sequence
  Synthetic Oligonucleotide
ccaaagucuauauaugacuauuaca

SEQ ID NO: 3582 - DNA, 25 bp, Artificial Sequence
  Synthetic Oligonucleotide
cucaggaugaaaaauuuugaaacca

SEQ ID NO: 3583 - DNA, 25 bp, Artificial Sequence
  Synthetic Oligonucleotide
auuaaccuguauucuguuuacaugt

SEQ ID NO: 3584 - DNA, 25 bp, Artificial Sequence
  Synthetic Oligonucleotide
ucagcauguauuacuugacaaagag

SEQ ID NO: 3585 - DNA, 25 bp, Artificial Sequence
  Synthetic Oligonucleotide
caauauuuucccaucuguauuautt

SEQ ID NO: 3586 - DNA, 25 bp, Artificial Sequence
  Synthetic Oligonucleotide
cuguaauuccccacuucaauacaaa

SEQ ID NO: 3587 - DNA, 25 bp, Artificial Sequence
  Synthetic Oligonucleotide
aaaguguugguaaugccugauucac

SEQ ID NO: 3588 - DNA, 25 bp, Artificial Sequence
  Synthetic Oligonucleotide
aagugcuguauccuuuaguaaaatt

SEQ ID NO: 3589 - DNA, 25 bp, Artificial Sequence
  Synthetic Oligonucleotide
cuuucauccuggaaauauauuaact

SEQ ID NO: 3590 - DNA, 25 bp, Artificial Sequence
  Synthetic Oligonucleotide
ggaugaugugcguaacagauucaaa

SEQ ID NO: 3591 - DNA, 25 bp, Artificial Sequence
  Synthetic Oligonucleotide
ugaaagucaucgacaagacauuggt

SEQ ID NO: 3592 - DNA, 25 bp, Artificial Sequence
  Synthetic Oligonucleotide
ucaggaugaaaaauuuugaaaccag

SEQ ID NO: 3593 - DNA, 25 bp, Artificial Sequence
  Synthetic Oligonucleotide
aaauauauuaacuguuaaaaagaaa

SEQ ID NO: 3594 - DNA, 25 bp, Artificial Sequence
  Synthetic Oligonucleotide
uuucagcauguauuacuugacaaag

SEQ ID NO: 3595 - DNA, 25 bp, Artificial Sequence
  Synthetic Oligonucleotide
uucagcauguauuacuugacaaaga

SEQ ID NO: 3596 - DNA, 25 bp, Artificial Sequence
  Synthetic Oligonucleotide
cacaauauuuucccaucuguauuat

SEQ ID NO: 3597 - DNA, 25 bp, Artificial Sequence
  Synthetic Oligonucleotide
aacacuaaggugaaaagauaaugat

SEQ ID NO: 3598 - DNA, 25 bp, Artificial Sequence
  Synthetic Oligonucleotide
aaugugaaagucaucgacaagacat

SEQ ID NO: 3599 - DNA, 25 bp, Artificial Sequence
  Synthetic Oligonucleotide
aaaaauuuugaaaccaguacuuuat

SEQ ID NO: 3600 - DNA, 25 bp, Artificial Sequence
  Synthetic Oligonucleotide
ggacuuucauccuggaaauauauta

SEQ ID NO: 3601 - DNA, 25 bp, Artificial Sequence
  Synthetic Oligonucleotide
aauuguaagcucagguucaaagugt

SEQ ID NO: 3602 - DNA, 25 bp, Artificial Sequence
  Synthetic Oligonucleotide
uccuggaaauauauuaacuguuaaa

SEQ ID NO: 3603 - DNA, 25 bp, Artificial Sequence
  Synthetic Oligonucleotide
uauuaacuguuaaaaagaaaacatt

SEQ ID NO: 3604 - DNA, 25 bp, Artificial Sequence
  Synthetic Oligonucleotide
ucccuuuuauuucauugcuuuugac

SEQ ID NO: 3605 - DNA, 25 bp, Artificial Sequence
  Synthetic Oligonucleotide
ccaaauguuuuaggauguauguuac

SEQ ID NO: 3606 - DNA, 25 bp, Artificial Sequence
  Synthetic Oligonucleotide
guuaaaaagaaaacauugaaaaugt

SEQ ID NO: 3607 - DNA, 25 bp, Artificial Sequence
  Synthetic Oligonucleotide
acugacaucauugccaauuguugca

SEQ ID NO: 3608 - DNA, 25 bp, Artificial Sequence
  Synthetic Oligonucleotide
ugaaaccaguacuuuaucauuuuct

SEQ ID NO: 3609 - DNA, 25 bp, Artificial Sequence
  Synthetic Oligonucleotide
cuauugauguucugccagaaauugt

SEQ ID NO: 3610 - DNA, 25 bp, Artificial Sequence
  Synthetic Oligonucleotide
aauauauuaacuguuaaaaagaaaa

SEQ ID NO: 3611 - DNA, 25 bp, Artificial Sequence
  Synthetic Oligonucleotide
cccuuuuauuucauugcuuuugact

SEQ ID NO: 3612 - DNA, 25 bp, Artificial Sequence
  Synthetic Oligonucleotide
cucauuguuuauuaaccuguauuct

SEQ ID NO: 3613 - DNA, 25 bp, Artificial Sequence
  Synthetic Oligonucleotide
gaugaugugcguaacagauucaaac

SEQ ID NO: 3614 - DNA, 25 bp, Artificial Sequence
  Synthetic Oligonucleotide
aauggacuuucauccuggaaauata

SEQ ID NO: 3615 - DNA, 25 bp, Artificial Sequence
  Synthetic Oligonucleotide
uuuugaaaccaguacuuuaucautt

SEQ ID NO: 3616 - DNA, 25 bp, Artificial Sequence
  Synthetic Oligonucleotide
acaacucaggaugaaaaauuuugaa

SEQ ID NO: 3617 - DNA, 25 bp, Artificial Sequence
  Synthetic Oligonucleotide
cauguauuacuugacaaagagacac

SEQ ID NO: 3618 - DNA, 25 bp, Artificial Sequence
  Synthetic Oligonucleotide
aaauuguaagcucagguucaaagtg

SEQ ID NO: 3619 - DNA, 25 bp, Artificial Sequence
  Synthetic Oligonucleotide
guuuauuaaccuguauucuguuuac

SEQ ID NO: 3620 - DNA, 25 bp, Artificial Sequence
  Synthetic Oligonucleotide
aaaccaguacuuuaucauuuucucc

SEQ ID NO: 3621 - DNA, 25 bp, Artificial Sequence
  Synthetic Oligonucleotide
gaaugugaaagucaucgacaagaca

SEQ ID NO: 3622 - DNA, 25 bp, Artificial Sequence
  Synthetic Oligonucleotide
aucaaugauuaugaacaacaugcta

SEQ ID NO: 3623 - DNA, 25 bp, Artificial Sequence
  Synthetic Oligonucleotide
uaaugaucucauuguuuauuaacct

SEQ ID NO: 3624 - DNA, 25 bp, Artificial Sequence
  Synthetic Oligonucleotide
guauucuguuuacaugucuuuaaaa

SEQ ID NO: 3625 - DNA, 25 bp, Artificial Sequence
  Synthetic Oligonucleotide
auauuuucccaucuguauuauuutt

SEQ ID NO: 3626 - DNA, 25 bp, Artificial Sequence
  Synthetic Oligonucleotide
agugucugaauauauccaaaugutt

SEQ ID NO: 3627 - DNA, 25 bp, Artificial Sequence
  Synthetic Oligonucleotide
acaauauuuucccaucuguauuatt

SEQ ID NO: 3628 - DNA, 25 bp, Artificial Sequence
  Synthetic Oligonucleotide
cguucuuuuccaacaaaauagcaat

SEQ ID NO: 3629 - DNA, 25 bp, Artificial Sequence
  Synthetic Oligonucleotide
gacaucauugccaauuguugcaaag

SEQ ID NO: 3630 - DNA, 25 bp, Artificial Sequence
  Synthetic Oligonucleotide
guguugguaaugccugauucacaac

SEQ ID NO: 3631 - DNA, 25 bp, Artificial Sequence
  Synthetic Oligonucleotide
agacugacaucauugccaauugutg

SEQ ID NO: 3632 - DNA, 25 bp, Artificial Sequence
  Synthetic Oligonucleotide
aaagauaaugaucucauuguuuatt

SEQ ID NO: 3633 - DNA, 25 bp, Artificial Sequence
  Synthetic Oligonucleotide
aacucaggaugaaaaauuuugaaac

SEQ ID NO: 3634 - DNA, 25 bp, Artificial Sequence
  Synthetic Oligonucleotide
gauaauauugcagcauuuuccagat

SEQ ID NO: 3635 - DNA, 25 bp, Artificial Sequence
  Synthetic Oligonucleotide
aaccaguacuuuaucauuuucucct

SEQ ID NO: 3636 - DNA, 25 bp, Artificial Sequence
  Synthetic Oligonucleotide
aauauuuucccaucuguauuauutt

SEQ ID NO: 3637 - DNA, 25 bp, Artificial Sequence
  Synthetic Oligonucleotide
caguacuuuaucauuuucuccugag

SEQ ID NO: 3638 - DNA, 25 bp, Artificial Sequence
  Synthetic Oligonucleotide
caguacuuccaaagucuauauauga

SEQ ID NO: 3639 - DNA, 25 bp, Artificial Sequence
  Synthetic Oligonucleotide
cuaaggugaaaagauaaugaucuca

SEQ ID NO: 3640 - DNA, 25 bp, Artificial Sequence
  Synthetic Oligonucleotide
agcucagguucaaaguguugguaat

SEQ ID NO: 3641 - DNA, 25 bp, Artificial Sequence
  Synthetic Oligonucleotide
cugagaagacugacaucauugccaa

SEQ ID NO: 3642 - DNA, 25 bp, Artificial Sequence
  Synthetic Oligonucleotide
ggugaaaagauaaugaucucauugt

SEQ ID NO: 3643 - DNA, 25 bp, Artificial Sequence
  Synthetic Oligonucleotide
agaaugugaaagucaucgacaagac

SEQ ID NO: 3644 - DNA, 25 bp, Artificial Sequence
  Synthetic Oligonucleotide
gcauguauuacuugacaaagagaca

SEQ ID NO: 3645 - DNA, 25 bp, Artificial Sequence
  Synthetic Oligonucleotide
cauugcuuuugacuuuucaaugggt

SEQ ID NO: 3646 - DNA, 25 bp, Artificial Sequence
  Synthetic Oligonucleotide
uaaggugaaaagauaaugaucucat

SEQ ID NO: 3647 - DNA, 25 bp, Artificial Sequence
  Synthetic Oligonucleotide
ccugauucacaacuuugagaaggta

SEQ ID NO: 3648 - DNA, 25 bp, Artificial Sequence
  Synthetic Oligonucleotide
caaucccuuuuauuucauugcuutt

SEQ ID NO: 3649 - DNA, 25 bp, Artificial Sequence
  Synthetic Oligonucleotide
uauuucauugcuuuugacuuuucaa

SEQ ID NO: 3650 - DNA, 25 bp, Artificial Sequence
  Synthetic Oligonucleotide
gucuguaauuccccacuucaauaca

SEQ ID NO: 3651 - DNA, 25 bp, Artificial Sequence
  Synthetic Oligonucleotide
ugauacuucuuugaauguagauutc

SEQ ID NO: 3652 - DNA, 25 bp, Artificial Sequence
  Synthetic Oligonucleotide
caaugauuaugaacaacaugcuaaa

SEQ ID NO: 3653 - DNA, 25 bp, Artificial Sequence
  Synthetic Oligonucleotide
gugcuguauccuuuaguaaaauugg

SEQ ID NO: 3654 - DNA, 25 bp, Artificial Sequence
  Synthetic Oligonucleotide
gucguucuuuuccaacaaaauagca

SEQ ID NO: 3655 - DNA, 25 bp, Artificial Sequence
  Synthetic Oligonucleotide
acaaaauagcaaucccuuuuauutc

SEQ ID NO: 3656 - DNA, 25 bp, Artificial Sequence
  Synthetic Oligonucleotide
ucuguaauuccccacuucaauacaa

SEQ ID NO: 3657 - DNA, 25 bp, Artificial Sequence
  Synthetic Oligonucleotide
aaagucaucgacaagacauugguga

SEQ ID NO: 3658 - DNA, 25 bp, Artificial Sequence
  Synthetic Oligonucleotide
uuuauuaaccuguauucuguuuaca

SEQ ID NO: 3659 - DNA, 25 bp, Artificial Sequence
  Synthetic Oligonucleotide
auguuacuucuuagagagaaauaaa

SEQ ID NO: 3660 - DNA, 25 bp, Artificial Sequence
  Synthetic Oligonucleotide
uccaaauguuuuaggauguauguta

SEQ ID NO: 3661 - DNA, 25 bp, Artificial Sequence
  Synthetic Oligonucleotide
guucuuaaauuguaagcucaggutc

SEQ ID NO: 3662 - DNA, 25 bp, Artificial Sequence
  Synthetic Oligonucleotide
caacaaaauagcaaucccuuuuatt

SEQ ID NO: 3663 - DNA, 25 bp, Artificial Sequence
  Synthetic Oligonucleotide
gaacaacaugcuaaaucaguacutc

SEQ ID NO: 3664 - DNA, 25 bp, Artificial Sequence
  Synthetic Oligonucleotide
aaacacuaaggugaaaagauaauga

SEQ ID NO: 3665 - DNA, 25 bp, Artificial Sequence
  Synthetic Oligonucleotide
ggcuaauuuguaucaaugauuauga

SEQ ID NO: 3666 - DNA, 25 bp, Artificial Sequence
  Synthetic Oligonucleotide
auagcaaucccuuuuauuucauugc

SEQ ID NO: 3667 - DNA, 25 bp, Artificial Sequence
  Synthetic Oligonucleotide
uggacuuucauccuggaaauauatt

SEQ ID NO: 3668 - DNA, 25 bp, Artificial Sequence
  Synthetic Oligonucleotide
gcugauaauauugcagcauuuucca

SEQ ID NO: 3669 - DNA, 25 bp, Artificial Sequence
  Synthetic Oligonucleotide
aacaaaauagcaaucccuuuuautt

SEQ ID NO: 3670 - DNA, 25 bp, Artificial Sequence
  Synthetic Oligonucleotide
auguuuuaggauguauguuacuuct

SEQ ID NO: 3671 - DNA, 25 bp, Artificial Sequence
  Synthetic Oligonucleotide
uagugucugaauauauccaaaugtt

SEQ ID NO: 3672 - DNA, 25 bp, Artificial Sequence
  Synthetic Oligonucleotide
ccuuuuauuucauugcuuuugactt

SEQ ID NO: 3673 - DNA, 25 bp, Artificial Sequence
  Synthetic Oligonucleotide
gucugaauauauccaaauguuuuag

SEQ ID NO: 3674 - DNA, 25 bp, Artificial Sequence
  Synthetic Oligonucleotide
cagaaugugaaagucaucgacaaga

SEQ ID NO: 3675 - DNA, 25 bp, Artificial Sequence
  Synthetic Oligonucleotide
aaaauuuugaaaccaguacuuuatc

SEQ ID NO: 3676 - DNA, 25 bp, Artificial Sequence
  Synthetic Oligonucleotide
uuuucagcauguauuacuugacaaa

SEQ ID NO: 3677 - DNA, 25 bp, Artificial Sequence
  Synthetic Oligonucleotide
ucugaauauauccaaauguuuuagg

SEQ ID NO: 3678 - DNA, 25 bp, Artificial Sequence
  Synthetic Oligonucleotide
augaaaaauuuugaaaccaguactt

SEQ ID NO: 3679 - DNA, 25 bp, Artificial Sequence
  Synthetic Oligonucleotide
aggaugaaaaauuuugaaaccagta

SEQ ID NO: 3680 - DNA, 25 bp, Artificial Sequence
  Synthetic Oligonucleotide
caaagucuauauaugacuauuacag

SEQ ID NO: 3681 - DNA, 25 bp, Artificial Sequence
  Synthetic Oligonucleotide
gugucugaauauauccaaauguutt

SEQ ID NO: 3682 - DNA, 25 bp, Artificial Sequence
  Synthetic Oligonucleotide
augauuaugaacaacaugcuaaatc

SEQ ID NO: 3683 - DNA, 25 bp, Artificial Sequence
  Synthetic Oligonucleotide
uuaaaaagaaaacauugaaaaugtg

SEQ ID NO: 3684 - DNA, 25 bp, Artificial Sequence
  Synthetic Oligonucleotide
ugaaaagauaaugaucucauugutt

SEQ ID NO: 3685 - DNA, 25 bp, Artificial Sequence
  Synthetic Oligonucleotide
ucguucuuuuccaacaaaauagcaa

SEQ ID NO: 3686 - DNA, 25 bp, Artificial Sequence
  Synthetic Oligonucleotide
ugcuguauccuuuaguaaaauugga

SEQ ID NO: 3687 - DNA, 25 bp, Artificial Sequence
  Synthetic Oligonucleotide
agugcuguauccuuuaguaaaautg

SEQ ID NO: 3688 - DNA, 25 bp, Artificial Sequence
  Synthetic Oligonucleotide
aagucuauauaugacuauuacaggt

SEQ ID NO: 3689 - DNA, 25 bp, Artificial Sequence
  Synthetic Oligonucleotide
caaaguguugguaaugccugauuca

SEQ ID NO: 3690 - DNA, 25 bp, Artificial Sequence
  Synthetic Oligonucleotide
gguaauuggugauacuucuuugaat

SEQ ID NO: 3691 - DNA, 25 bp, Artificial Sequence
  Synthetic Oligonucleotide
caaauguuuuaggauguauguuact

SEQ ID NO: 3692 - DNA, 25 bp, Artificial Sequence
  Synthetic Oligonucleotide
auacuucuuugaauguagauuucca

SEQ ID NO: 3693 - DNA, 25 bp, Artificial Sequence
  Synthetic Oligonucleotide
gaucucauuguuuauuaaccuguat

SEQ ID NO: 3694 - DNA, 25 bp, Artificial Sequence
  Synthetic Oligonucleotide
aaauguuuuaggauguauguuactt

SEQ ID NO: 3695 - DNA, 25 bp, Artificial Sequence
  Synthetic Oligonucleotide
gagaagacugacaucauugccaatt

SEQ ID NO: 3696 - DNA, 25 bp, Artificial Sequence
  Synthetic Oligonucleotide
acuguuaaaaagaaaacauugaaaa

SEQ ID NO: 3697 - DNA, 25 bp, Artificial Sequence
  Synthetic Oligonucleotide
uauugauguucugccagaaauugtg

SEQ ID NO: 3698 - DNA, 25 bp, Artificial Sequence
  Synthetic Oligonucleotide
aacagugguucuuaaauuguaagct

SEQ ID NO: 3699 - DNA, 25 bp, Artificial Sequence
  Synthetic Oligonucleotide
uuucauccuggaaauauauuaactg

SEQ ID NO: 3700 - DNA, 25 bp, Artificial Sequence
  Synthetic Oligonucleotide
cuuuggcugauaauauugcagcatt

SEQ ID NO: 3701 - DNA, 25 bp, Artificial Sequence
  Synthetic Oligonucleotide
aucauuuucuccugaggaaaauutt

SEQ ID NO: 3702 - DNA, 25 bp, Artificial Sequence
  Synthetic Oligonucleotide
aucaguacuuccaaagucuauauat

SEQ ID NO: 3703 - DNA, 25 bp, Artificial Sequence
  Synthetic Oligonucleotide
uuuuauuucauugcuuuugacuutt

SEQ ID NO: 3704 - DNA, 25 bp, Artificial Sequence
  Synthetic Oligonucleotide
aaauggacuuucauccuggaaauat

SEQ ID NO: 3705 - DNA, 25 bp, Artificial Sequence
  Synthetic Oligonucleotide
cuuccaaagucuauauaugacuatt

SEQ ID NO: 3706 - DNA, 25 bp, Artificial Sequence
  Synthetic Oligonucleotide
ggugucguucuuuuccaacaaaata

SEQ ID NO: 3707 - DNA, 25 bp, Artificial Sequence
  Synthetic Oligonucleotide
aggugaaaagauaaugaucucautg

SEQ ID NO: 3708 - DNA, 25 bp, Artificial Sequence
  Synthetic Oligonucleotide
uauuacuugacaaagagacacugtg

SEQ ID NO: 3709 - DNA, 25 bp, Artificial Sequence
  Synthetic Oligonucleotide
gaugugcguaacagauucaaacugc

SEQ ID NO: 3710 - DNA, 25 bp, Artificial Sequence
  Synthetic Oligonucleotide
ugaaaaauuuugaaaccaguacutt

SEQ ID NO: 3711 - DNA, 25 bp, Artificial Sequence
  Synthetic Oligonucleotide
ugauaauauugcagcauuuuccaga

SEQ ID NO: 3712 - DNA, 25 bp, Artificial Sequence
  Synthetic Oligonucleotide
uggaugaugugcguaacagauucaa

SEQ ID NO: 3713 - DNA, 25 bp, Artificial Sequence
  Synthetic Oligonucleotide
cgacaagacauuggugaggaaaaat

SEQ ID NO: 3714 - DNA, 25 bp, Artificial Sequence
  Synthetic Oligonucleotide
aaguguugguaaugccugauucaca

SEQ ID NO: 3715 - DNA, 25 bp, Artificial Sequence
  Synthetic Oligonucleotide
aauggcugagaagacugacaucatt

SEQ ID NO: 3716 - DNA, 25 bp, Artificial Sequence
  Synthetic Oligonucleotide
gaagaaacuuuggcugauaauautg

SEQ ID NO: 3717 - DNA, 25 bp, Artificial Sequence
  Synthetic Oligonucleotide
aaaagauaaugaucucauuguuuat

SEQ ID NO: 3718 - DNA, 25 bp, Artificial Sequence
  Synthetic Oligonucleotide
uguaucaaugauuaugaacaacatg

SEQ ID NO: 3719 - DNA, 25 bp, Artificial Sequence
  Synthetic Oligonucleotide
gacugacaucauugccaauuguugc

SEQ ID NO: 3720 - DNA, 25 bp, Artificial Sequence
  Synthetic Oligonucleotide
agcaaacacuaaggugaaaagauaa

SEQ ID NO: 3721 - DNA, 25 bp, Artificial Sequence
  Synthetic Oligonucleotide
ugccagaaugugaaagucaucgaca

SEQ ID NO: 3722 - DNA, 25 bp, Artificial Sequence
  Synthetic Oligonucleotide
ccacuauugauguucugccagaaat

SEQ ID NO: 3723 - DNA, 25 bp, Artificial Sequence
  Synthetic Oligonucleotide
uuugaaaccaguacuuuaucauutt

SEQ ID NO: 3724 - DNA, 25 bp, Artificial Sequence
  Synthetic Oligonucleotide
uguaauuccccacuucaauacaaag

SEQ ID NO: 3725 - DNA, 25 bp, Artificial Sequence
  Synthetic Oligonucleotide
uagcaauaaccugugaaaaugcucc

SEQ ID NO: 3726 - DNA, 25 bp, Artificial Sequence
  Synthetic Oligonucleotide
aacuguuaaaaagaaaacauugaaa

SEQ ID NO: 3727 - DNA, 25 bp, Artificial Sequence
  Synthetic Oligonucleotide
cacaacucaggaugaaaaauuuuga

SEQ ID NO: 3728 - DNA, 25 bp, Artificial Sequence
  Synthetic Oligonucleotide
agguucaaaguguugguaaugcctg

SEQ ID NO: 3729 - DNA, 25 bp, Artificial Sequence
  Synthetic Oligonucleotide
aaccuguauucuguuuacauguctt

SEQ ID NO: 3730 - DNA, 25 bp, Artificial Sequence
  Synthetic Oligonucleotide
aucacaucuuuagugucugaauata

SEQ ID NO: 3731 - DNA, 25 bp, Artificial Sequence
  Synthetic Oligonucleotide
guaagcucagguucaaaguguuggt

SEQ ID NO: 3732 - DNA, 25 bp, Artificial Sequence
  Synthetic Oligonucleotide
cuuugaauguagauuuccaaucaca

SEQ ID NO: 3733 - DNA, 25 bp, Artificial Sequence
  Synthetic Oligonucleotide
ggaauguugcugaaacagaucugtc

SEQ ID NO: 3734 - DNA, 25 bp, Artificial Sequence
  Synthetic Oligonucleotide
uaacuguuaaaaagaaaacauugaa

SEQ ID NO: 3735 - DNA, 25 bp, Artificial Sequence
  Synthetic Oligonucleotide
auauauuaacuguuaaaaagaaaac

SEQ ID NO: 3736 - DNA, 25 bp, Artificial Sequence
  Synthetic Oligonucleotide
aauguuuuaggauguauguuacutc

SEQ ID NO: 3737 - DNA, 25 bp, Artificial Sequence
  Synthetic Oligonucleotide
uuguaucaaugauuaugaacaacat

SEQ ID NO: 3738 - DNA, 25 bp, Artificial Sequence
  Synthetic Oligonucleotide
uaaaacagugguucuuaaauuguaa

SEQ ID NO: 3739 - DNA, 25 bp, Artificial Sequence
  Synthetic Oligonucleotide
agaaacuuuggcugauaauauugca

SEQ ID NO: 3740 - DNA, 25 bp, Artificial Sequence
  Synthetic Oligonucleotide
aagaucugacagugcacaauauutt

SEQ ID NO: 3741 - DNA, 25 bp, Artificial Sequence
  Synthetic Oligonucleotide
aaggugaaaagauaaugaucucatt

SEQ ID NO: 3742 - DNA, 25 bp, Artificial Sequence
  Synthetic Oligonucleotide
auauugcagcauuuuccagauggaa

SEQ ID NO: 3743 - DNA, 25 bp, Artificial Sequence
  Synthetic Oligonucleotide
uagcaaacacuaaggugaaaagata

SEQ ID NO: 3744 - DNA, 25 bp, Artificial Sequence
  Synthetic Oligonucleotide
gguaaugccugauucacaacuuuga

SEQ ID NO: 3745 - DNA, 25 bp, Artificial Sequence
  Synthetic Oligonucleotide
ugugaaagucaucgacaagacautg

SEQ ID NO: 3746 - DNA, 25 bp, Artificial Sequence
  Synthetic Oligonucleotide
aaaacagugguucuuaaauuguaag

SEQ ID NO: 3747 - DNA, 25 bp, Artificial Sequence
  Synthetic Oligonucleotide
uguauucuguuuacaugucuuuaaa

SEQ ID NO: 3748 - DNA, 25 bp, Artificial Sequence
  Synthetic Oligonucleotide
agaagacugacaucauugccaautg

SEQ ID NO: 3749 - DNA, 25 bp, Artificial Sequence
  Synthetic Oligonucleotide
uuaaauuguaagcucagguucaaag

SEQ ID NO: 3750 - DNA, 25 bp, Artificial Sequence
  Synthetic Oligonucleotide
gcaaacacuaaggugaaaagauaat

SEQ ID NO: 3751 - DNA, 25 bp, Artificial Sequence
  Synthetic Oligonucleotide
cagguucaaaguguugguaaugcct

SEQ ID NO: 3752 - DNA, 25 bp, Artificial Sequence
  Synthetic Oligonucleotide
caagacauuggugaggaaaaaucct

SEQ ID NO: 3753 - DNA, 25 bp, Artificial Sequence
  Synthetic Oligonucleotide
guagcaaacacuaaggugaaaagat

SEQ ID NO: 3754 - DNA, 25 bp, Artificial Sequence
  Synthetic Oligonucleotide
aaacagugguucuuaaauuguaagc

SEQ ID NO: 3755 - DNA, 25 bp, Artificial Sequence
  Synthetic Oligonucleotide
ucaaaguguugguaaugccugautc

SEQ ID NO: 3756 - DNA, 25 bp, Artificial Sequence
  Synthetic Oligonucleotide
uuaaccuguauucuguuuacaugtc

SEQ ID NO: 3757 - DNA, 25 bp, Artificial Sequence
  Synthetic Oligonucleotide
guugguaaugccugauucacaactt

SEQ ID NO: 3758 - DNA, 25 bp, Artificial Sequence
  Synthetic Oligonucleotide
aguacuuccaaagucuauauaugac

SEQ ID NO: 3759 - DNA, 25 bp, Artificial Sequence
  Synthetic Oligonucleotide
guacuuccaaagucuauauaugact

SEQ ID NO: 3760 - DNA, 25 bp, Artificial Sequence
  Synthetic Oligonucleotide
aaugauuaugaacaacaugcuaaat

SEQ ID NO: 3761 - DNA, 25 bp, Artificial Sequence
  Synthetic Oligonucleotide
uucaagauguccucgagauacuaaa

SEQ ID NO: 3762 - DNA, 25 bp, Artificial Sequence
  Synthetic Oligonucleotide
uuaaaacagugguucuuaaauugta

SEQ ID NO: 3763 - DNA, 25 bp, Artificial Sequence
  Synthetic Oligonucleotide
ucucauuguuuauuaaccuguautc

SEQ ID NO: 3764 - DNA, 25 bp, Artificial Sequence
  Synthetic Oligonucleotide
uguugguaaugccugauucacaact

SEQ ID NO: 3765 - DNA, 25 bp, Artificial Sequence
  Synthetic Oligonucleotide
aacaugcuaaaucaguacuuccaaa

SEQ ID NO: 3766 - DNA, 25 bp, Artificial Sequence
  Synthetic Oligonucleotide
cuuaaauuguaagcucagguucaaa

SEQ ID NO: 3767 - DNA, 25 bp, Artificial Sequence
  Synthetic Oligonucleotide
cguuggcugcaacuguauaucuaca

SEQ ID NO: 3768 - DNA, 25 bp, Artificial Sequence
  Synthetic Oligonucleotide
aaucaguacuuccaaagucuauata

SEQ ID NO: 3769 - DNA, 25 bp, Artificial Sequence
  Synthetic Oligonucleotide
aagacauuggugaggaaaaaucctt

SEQ ID NO: 3770 - DNA, 25 bp, Artificial Sequence
  Synthetic Oligonucleotide
auguauuacuugacaaagagacact

SEQ ID NO: 3771 - DNA, 25 bp, Artificial Sequence
  Synthetic Oligonucleotide
gauacuucuuugaauguagauuucc

SEQ ID NO: 3772 - DNA, 25 bp, Artificial Sequence
  Synthetic Oligonucleotide
agaucugacagugcacaauauuutc

SEQ ID NO: 3773 - DNA, 25 bp, Artificial Sequence
  Synthetic Oligonucleotide
aucuuuagugucugaauauauccaa

SEQ ID NO: 3774 - DNA, 25 bp, Artificial Sequence
  Synthetic Oligonucleotide
caaacacuaaggugaaaagauaatg

SEQ ID NO: 3775 - DNA, 25 bp, Artificial Sequence
  Synthetic Oligonucleotide
agcaauaaccugugaaaaugcuccc

SEQ ID NO: 3776 - DNA, 25 bp, Artificial Sequence
  Synthetic Oligonucleotide
uauauuaacuguuaaaaagaaaaca

SEQ ID NO: 3777 - DNA, 25 bp, Artificial Sequence
  Synthetic Oligonucleotide
augugcguaacagauucaaacugcc

SEQ ID NO: 3778 - DNA, 25 bp, Artificial Sequence
  Synthetic Oligonucleotide
ucaguacuuccaaagucuauauatg

SEQ ID NO: 3779 - DNA, 25 bp, Artificial Sequence
  Synthetic Oligonucleotide
uaauuggugauacuucuuugaaugt

SEQ ID NO: 3780 - DNA, 25 bp, Artificial Sequence
  Synthetic Oligonucleotide
ccaacaaaauagcaaucccuuuuat

SEQ ID NO: 3781 - DNA, 25 bp, Artificial Sequence
  Synthetic Oligonucleotide
uaagcucagguucaaaguguuggta

SEQ ID NO: 3782 - DNA, 25 bp, Artificial Sequence
  Synthetic Oligonucleotide
cugacagugcacaauauuuucccat

SEQ ID NO: 3783 - DNA, 25 bp, Artificial Sequence
  Synthetic Oligonucleotide
gcagcauuuuccagauggaagcugt

SEQ ID NO: 3784 - DNA, 25 bp, Artificial Sequence
  Synthetic Oligonucleotide
gguucuuaaauuguaagcucaggtt

SEQ ID NO: 3785 - DNA, 25 bp, Artificial Sequence
  Synthetic Oligonucleotide
augaagaaacuuuggcugauaauat

SEQ ID NO: 3786 - DNA, 25 bp, Artificial Sequence
  Synthetic Oligonucleotide
acacuaaggugaaaagauaaugatc

SEQ ID NO: 3787 - DNA, 25 bp, Artificial Sequence
  Synthetic Oligonucleotide
uguuuauuaaccuguauucuguuta

SEQ ID NO: 3788 - DNA, 25 bp, Artificial Sequence
  Synthetic Oligonucleotide
ccacaacucaggaugaaaaauuutg

SEQ ID NO: 3789 - DNA, 25 bp, Artificial Sequence
  Synthetic Oligonucleotide
aaacuuuggcugauaauauugcagc

SEQ ID NO: 3790 - DNA, 25 bp, Artificial Sequence
  Synthetic Oligonucleotide
gcacaauauuuucccaucuguauta

SEQ ID NO: 3791 - DNA, 25 bp, Artificial Sequence
  Synthetic Oligonucleotide
gaaagucaucgacaagacauuggtg

SEQ ID NO: 3792 - DNA, 25 bp, Artificial Sequence
  Synthetic Oligonucleotide
uuaugaacaacaugcuaaaucagta

SEQ ID NO: 3793 - DNA, 25 bp, Artificial Sequence
  Synthetic Oligonucleotide
cuguauucuguuuacaugucuuuaa

SEQ ID NO: 3794 - DNA, 25 bp, Artificial Sequence
  Synthetic Oligonucleotide
auaauauugcagcauuuuccagatg

SEQ ID NO: 3795 - DNA, 25 bp, Artificial Sequence
  Synthetic Oligonucleotide
auuuucccaucuguauuauuuuutt

SEQ ID NO: 3796 - DNA, 25 bp, Artificial Sequence
  Synthetic Oligonucleotide
uauguuacuucuuagagagaaauaa

SEQ ID NO: 3797 - DNA, 25 bp, Artificial Sequence
  Synthetic Oligonucleotide
aucgacaagacauuggugaggaaaa

SEQ ID NO: 3798 - DNA, 25 bp, Artificial Sequence
  Synthetic Oligonucleotide
cucagguucaaaguguugguaaugc

SEQ ID NO: 3799 - DNA, 25 bp, Artificial Sequence
  Synthetic Oligonucleotide
guauuacuugacaaagagacacugt

SEQ ID NO: 3800 - DNA, 25 bp, Artificial Sequence
  Synthetic Oligonucleotide
uguauuacuugacaaagagacactg

SEQ ID NO: 3801 - DNA, 25 bp, Artificial Sequence
  Synthetic Oligonucleotide
ugucguucuuuuccaacaaaauagc

SEQ ID NO: 3802 - DNA, 25 bp, Artificial Sequence
  Synthetic Oligonucleotide
aaagucuauauaugacuauuacagg

SEQ ID NO: 3803 - DNA, 25 bp, Artificial Sequence
  Synthetic Oligonucleotide
gguagcaaacacuaaggugaaaaga

SEQ ID NO: 3804 - DNA, 25 bp, Artificial Sequence
  Synthetic Oligonucleotide
aucaaauggcugagaagacugacat

SEQ ID NO: 3805 - DNA, 25 bp, Artificial Sequence
  Synthetic Oligonucleotide
accaguacuuuaucauuuucucctg

SEQ ID NO: 3806 - DNA, 25 bp, Artificial Sequence
  Synthetic Oligonucleotide
uaaugccugauucacaacuuugaga

SEQ ID NO: 3807 - DNA, 25 bp, Artificial Sequence
  Synthetic Oligonucleotide
acuauugauguucugccagaaautg

SEQ ID NO: 3808 - DNA, 25 bp, Artificial Sequence
  Synthetic Oligonucleotide
uuauuaaccuguauucuguuuacat

SEQ ID NO: 3809 - DNA, 25 bp, Artificial Sequence
  Synthetic Oligonucleotide
auugauguucugccagaaauugugg

SEQ ID NO: 3810 - DNA, 25 bp, Artificial Sequence
  Synthetic Oligonucleotide
ggaugaaaaauuuugaaaccaguac

SEQ ID NO: 3811 - DNA, 25 bp, Artificial Sequence
  Synthetic Oligonucleotide
ucauuuucuccugaggaaaauuutg

SEQ ID NO: 3812 - DNA, 25 bp, Artificial Sequence
  Synthetic Oligonucleotide
guaaugccugauucacaacuuugag

SEQ ID NO: 3813 - DNA, 25 bp, Artificial Sequence
  Synthetic Oligonucleotide
ccuguauucuguuuacaugucuuta

SEQ ID NO: 3814 - DNA, 25 bp, Artificial Sequence
  Synthetic Oligonucleotide
gucaucgacaagacauuggugagga

SEQ ID NO: 3815 - DNA, 25 bp, Artificial Sequence
  Synthetic Oligonucleotide
aagaaacuuuggcugauaauauugc

SEQ ID NO: 3816 - DNA, 25 bp, Artificial Sequence
  Synthetic Oligonucleotide
agugguucuuaaauuguaagcucag

SEQ ID NO: 3817 - DNA, 25 bp, Artificial Sequence
  Synthetic Oligonucleotide
uauauccaaauguuuuaggauguat

SEQ ID NO: 3818 - DNA, 25 bp, Artificial Sequence
  Synthetic Oligonucleotide
agacauuggugaggaaaaauccutt

SEQ ID NO: 3819 - DNA, 25 bp, Artificial Sequence
  Synthetic Oligonucleotide
ugacagugcacaauauuuucccatc

SEQ ID NO: 3820 - DNA, 25 bp, Artificial Sequence
  Synthetic Oligonucleotide
gccagaaugugaaagucaucgacaa

SEQ ID NO: 3821 - DNA, 25 bp, Artificial Sequence
  Synthetic Oligonucleotide
aauguagauuuccaaucacaucutt

SEQ ID NO: 3822 - DNA, 25 bp, Artificial Sequence
  Synthetic Oligonucleotide
uguuaaaaagaaaacauugaaaatg

SEQ ID NO: 3823 - DNA, 25 bp, Artificial Sequence
  Synthetic Oligonucleotide
ugaacaacaugcuaaaucaguactt

SEQ ID NO: 3824 - DNA, 25 bp, Artificial Sequence
  Synthetic Oligonucleotide
uaucaaugauuaugaacaacaugct

SEQ ID NO: 3825 - DNA, 25 bp, Artificial Sequence
  Synthetic Oligonucleotide
auucuguuuacaugucuuuaaaaca

SEQ ID NO: 3826 - DNA, 25 bp, Artificial Sequence
  Synthetic Oligonucleotide
acucaggaugaaaaauuuugaaacc

SEQ ID NO: 3827 - DNA, 25 bp, Artificial Sequence
  Synthetic Oligonucleotide
auccaaauguuuuaggauguaugtt

SEQ ID NO: 3828 - DNA, 25 bp, Artificial Sequence
  Synthetic Oligonucleotide
cgguaauuggugauacuucuuugaa

SEQ ID NO: 3829 - DNA, 25 bp, Artificial Sequence
  Synthetic Oligonucleotide
ugaagaaacuuuggcugauaauatt

SEQ ID NO: 3830 - DNA, 25 bp, Artificial Sequence
  Synthetic Oligonucleotide
ucauugcuuuugacuuuucaauggg

SEQ ID NO: 3831 - DNA, 25 bp, Artificial Sequence
  Synthetic Oligonucleotide
ugucugaauauauccaaauguuuta

SEQ ID NO: 3832 - DNA, 25 bp, Artificial Sequence
  Synthetic Oligonucleotide
uuguuuauuaaccuguauucugutt

SEQ ID NO: 3833 - DNA, 25 bp, Artificial Sequence
  Synthetic Oligonucleotide
auauccaaauguuuuaggauguatg

SEQ ID NO: 3834 - DNA, 25 bp, Artificial Sequence
  Synthetic Oligonucleotide
cagugcacaauauuuucccaucugt

SEQ ID NO: 3835 - DNA, 25 bp, Artificial Sequence
  Synthetic Oligonucleotide
accuguauucuguuuacaugucutt

SEQ ID NO: 3836 - DNA, 25 bp, Artificial Sequence
  Synthetic Oligonucleotide
augccugauucacaacuuugagaag

SEQ ID NO: 3837 - DNA, 25 bp, Artificial Sequence
  Synthetic Oligonucleotide
uugauguucugccagaaauugugga

SEQ ID NO: 3838 - DNA, 25 bp, Artificial Sequence
  Synthetic Oligonucleotide
gaauguagauuuccaaucacauctt

SEQ ID NO: 3839 - DNA, 25 bp, Artificial Sequence
  Synthetic Oligonucleotide
cuuuuauuucauugcuuuugacutt

SEQ ID NO: 3840 - DNA, 25 bp, Artificial Sequence
  Synthetic Oligonucleotide
ccagaaugugaaagucaucgacaag

SEQ ID NO: 3841 - DNA, 25 bp, Artificial Sequence
  Synthetic Oligonucleotide
augugaaagucaucgacaagacatt

SEQ ID NO: 3842 - DNA, 25 bp, Artificial Sequence
  Synthetic Oligonucleotide
augaugugcguaacagauucaaact

SEQ ID NO: 3843 - DNA, 25 bp, Artificial Sequence
  Synthetic Oligonucleotide
gcucagguucaaaguguugguaatg

SEQ ID NO: 3844 - DNA, 25 bp, Artificial Sequence
  Synthetic Oligonucleotide
uucuguuuacaugucuuuaaaacag

SEQ ID NO: 3845 - DNA, 25 bp, Artificial Sequence
  Synthetic Oligonucleotide
acaagacauuggugaggaaaaaucc

SEQ ID NO: 3846 - DNA, 25 bp, Artificial Sequence
  Synthetic Oligonucleotide
guaaaauuggagguagcaaacacta

SEQ ID NO: 3847 - DNA, 25 bp, Artificial Sequence
  Synthetic Oligonucleotide
uacuuccaaagucuauauaugacta

SEQ ID NO: 3848 - DNA, 25 bp, Artificial Sequence
  Synthetic Oligonucleotide
auguagauuuccaaucacaucuuta

SEQ ID NO: 3849 - DNA, 25 bp, Artificial Sequence
  Synthetic Oligonucleotide
caagaucugacagugcacaauautt

SEQ ID NO: 3850 - DNA, 25 bp, Artificial Sequence
  Synthetic Oligonucleotide
acuucuuugaauguagauuuccaat

SEQ ID NO: 3851 - DNA, 25 bp, Artificial Sequence
  Synthetic Oligonucleotide
cugauaauauugcagcauuuuccag

SEQ ID NO: 3852 - DNA, 25 bp, Artificial Sequence
  Synthetic Oligonucleotide
gcuaaaucaguacuuccaaagucta

SEQ ID NO: 3853 - DNA, 25 bp, Artificial Sequence
  Synthetic Oligonucleotide
gagagaaauaaagcauuuuugggaa

SEQ ID NO: 3854 - DNA, 25 bp, Artificial Sequence
  Synthetic Oligonucleotide
auauauccaaauguuuuaggaugta

SEQ ID NO: 3855 - DNA, 25 bp, Artificial Sequence
  Synthetic Oligonucleotide
uuauuucauugcuuuugacuuuuca

SEQ ID NO: 3856 - DNA, 25 bp, Artificial Sequence
  Synthetic Oligonucleotide
agugcacaauauuuucccaucugta

SEQ ID NO: 3857 - DNA, 25 bp, Artificial Sequence
  Synthetic Oligonucleotide
cacaucuuuagugucugaauauatc

SEQ ID NO: 3858 - DNA, 25 bp, Artificial Sequence
  Synthetic Oligonucleotide
guauguuacuucuuagagagaaata

SEQ ID NO: 3859 - DNA, 25 bp, Artificial Sequence
  Synthetic Oligonucleotide
aggaaccuuuuagaaagaaauggac

SEQ ID NO: 3860 - DNA, 25 bp, Artificial Sequence
  Synthetic Oligonucleotide
guucaagauguccucgagauacuaa

SEQ ID NO: 3861 - DNA, 25 bp, Artificial Sequence
  Synthetic Oligonucleotide
cggcuaauuuguaucaaugauuatg

SEQ ID NO: 3862 - DNA, 25 bp, Artificial Sequence
  Synthetic Oligonucleotide
agggugucguucuuuuccaacaaaa

SEQ ID NO: 3863 - DNA, 25 bp, Artificial Sequence
  Synthetic Oligonucleotide
ccuuuuagaaagaaauggacuuuca

SEQ ID NO: 3864 - DNA, 25 bp, Artificial Sequence
  Synthetic Oligonucleotide
auugcuuuugacuuuucaaugggtg

SEQ ID NO: 3865 - DNA, 25 bp, Artificial Sequence
  Synthetic Oligonucleotide
caaauggcugagaagacugacauca

SEQ ID NO: 3866 - DNA, 25 bp, Artificial Sequence
  Synthetic Oligonucleotide
guucuuuuccaacaaaauagcaatc

SEQ ID NO: 3867 - DNA, 25 bp, Artificial Sequence
  Synthetic Oligonucleotide
gugucguucuuuuccaacaaaauag

SEQ ID NO: 3868 - DNA, 25 bp, Artificial Sequence
  Synthetic Oligonucleotide
uauuaaccuguauucuguuuacatg

SEQ ID NO: 3869 - DNA, 25 bp, Artificial Sequence
  Synthetic Oligonucleotide
uaaauuguaagcucagguucaaagt

SEQ ID NO: 3870 - DNA, 25 bp, Artificial Sequence
  Synthetic Oligonucleotide
gcugagaagacugacaucauugcca

SEQ ID NO: 3871 - DNA, 25 bp, Artificial Sequence
  Synthetic Oligonucleotide
cggaauguugcugaaacagaucugt

SEQ ID NO: 3872 - DNA, 25 bp, Artificial Sequence
  Synthetic Oligonucleotide
aauauauccaaauguuuuaggaugt

SEQ ID NO: 3873 - DNA, 25 bp, Artificial Sequence
  Synthetic Oligonucleotide
cagucuguaauuccccacuucaata

SEQ ID NO: 3874 - DNA, 25 bp, Artificial Sequence
  Synthetic Oligonucleotide
ggcugcaacuguauaucuacaagga

SEQ ID NO: 3875 - DNA, 25 bp, Artificial Sequence
  Synthetic Oligonucleotide
uuaacuguuaaaaagaaaacauuga

SEQ ID NO: 3876 - DNA, 25 bp, Artificial Sequence
  Synthetic Oligonucleotide
gaugaagaaacuuuggcugauaata

SEQ ID NO: 3877 - DNA, 25 bp, Artificial Sequence
  Synthetic Oligonucleotide
caacaugcuaaaucaguacuuccaa

SEQ ID NO: 3878 - DNA, 25 bp, Artificial Sequence
  Synthetic Oligonucleotide
uggugauacuucuuugaauguagat

SEQ ID NO: 3879 - DNA, 25 bp, Artificial Sequence
  Synthetic Oligonucleotide
auucacaacuuugagaagguagcac

SEQ ID NO: 3880 - DNA, 25 bp, Artificial Sequence
  Synthetic Oligonucleotide
uucauugcuuuugacuuuucaaugg

SEQ ID NO: 3881 - DNA, 25 bp, Artificial Sequence
  Synthetic Oligonucleotide
uuuuccagauggaagcuguauccaa

SEQ ID NO: 3882 - DNA, 25 bp, Artificial Sequence
  Synthetic Oligonucleotide
uauucuguuuacaugucuuuaaaac

SEQ ID NO: 3883 - DNA, 25 bp, Artificial Sequence
  Synthetic Oligonucleotide
cuugacaaagagacacugugcagag

SEQ ID NO: 3884 - DNA, 25 bp, Artificial Sequence
  Synthetic Oligonucleotide
guucaaaguguugguaaugccugat

SEQ ID NO: 3885 - DNA, 25 bp, Artificial Sequence
  Synthetic Oligonucleotide
cuguuaaaaagaaaacauugaaaat

SEQ ID NO: 3886 - DNA, 25 bp, Artificial Sequence
  Synthetic Oligonucleotide
auacaaagggugucguucuuuucca

SEQ ID NO: 3887 - DNA, 25 bp, Artificial Sequence
  Synthetic Oligonucleotide
cuuuaucauuuucuccugaggaaaa

SEQ ID NO: 3888 - DNA, 25 bp, Artificial Sequence
  Synthetic Oligonucleotide
uuuaaaacagugguucuuaaauugt

SEQ ID NO: 3889 - DNA, 25 bp, Artificial Sequence
  Synthetic Oligonucleotide
caaucacaucuuuagugucugaata

SEQ ID NO: 3890 - DNA, 25 bp, Artificial Sequence
  Synthetic Oligonucleotide
uccaaagucuauauaugacuauuac

SEQ ID NO: 3891 - DNA, 25 bp, Artificial Sequence
  Synthetic Oligonucleotide
uaucauuuucuccugaggaaaautt

SEQ ID NO: 3892 - DNA, 25 bp, Artificial Sequence
  Synthetic Oligonucleotide
uguuacuucuuagagagaaauaaag

SEQ ID NO: 3893 - DNA, 25 bp, Artificial Sequence
  Synthetic Oligonucleotide
guacuuuaucauuuucuccugagga

SEQ ID NO: 3894 - DNA, 25 bp, Artificial Sequence
  Synthetic Oligonucleotide
ucugacagugcacaauauuuuccca

SEQ ID NO: 3895 - DNA, 25 bp, Artificial Sequence
  Synthetic Oligonucleotide
aagauguccucgagauacuaaagga

SEQ ID NO: 3896 - DNA, 25 bp, Artificial Sequence
  Synthetic Oligonucleotide
acuugacaaagagacacugugcaga

SEQ ID NO: 3897 - DNA, 25 bp, Artificial Sequence
  Synthetic Oligonucleotide
ugccugauucacaacuuugagaagg

SEQ ID NO: 3898 - DNA, 25 bp, Artificial Sequence
  Synthetic Oligonucleotide
uaugaacaacaugcuaaaucaguac

SEQ ID NO: 3899 - DNA, 25 bp, Artificial Sequence
  Synthetic Oligonucleotide
uuguaagcucagguucaaagugutg

SEQ ID NO: 3900 - DNA, 25 bp, Artificial Sequence
  Synthetic Oligonucleotide
gaaauggacuuucauccuggaaata

SEQ ID NO: 3901 - DNA, 25 bp, Artificial Sequence
  Synthetic Oligonucleotide
aaagugcuguauccuuuaguaaaat

SEQ ID NO: 3902 - DNA, 25 bp, Artificial Sequence
  Synthetic Oligonucleotide
agugggugccagaaugugaaaguca

SEQ ID NO: 3903 - DNA, 25 bp, Artificial Sequence
  Synthetic Oligonucleotide
gauguauguuacuucuuagagagaa

SEQ ID NO: 3904 - DNA, 25 bp, Artificial Sequence
  Synthetic Oligonucleotide
gugaaagucaucgacaagacauugg

SEQ ID NO: 3905 - DNA, 25 bp, Artificial Sequence
  Synthetic Oligonucleotide
agauaucaaauggcugagaagactg

SEQ ID NO: 3906 - DNA, 25 bp, Artificial Sequence
  Synthetic Oligonucleotide
ucuguuuacaugucuuuaaaacagt

SEQ ID NO: 3907 - DNA, 25 bp, Artificial Sequence
  Synthetic Oligonucleotide
cacuaaggugaaaagauaaugauct

SEQ ID NO: 3908 - DNA, 25 bp, Artificial Sequence
  Synthetic Oligonucleotide
gucuauauaugacuauuacagguct

SEQ ID NO: 3909 - DNA, 25 bp, Artificial Sequence
  Synthetic Oligonucleotide
acuuuaucauuuucuccugaggaaa

SEQ ID NO: 3910 - DNA, 25 bp, Artificial Sequence
  Synthetic Oligonucleotide
cagcauuuuccagauggaagcugta

SEQ ID NO: 3911 - DNA, 25 bp, Artificial Sequence
  Synthetic Oligonucleotide
ucuuuagugucugaauauauccaaa

SEQ ID NO: 3912 - DNA, 25 bp, Artificial Sequence
  Synthetic Oligonucleotide
gugccagaaugugaaagucaucgac

SEQ ID NO: 3913 - DNA, 25 bp, Artificial Sequence
  Synthetic Oligonucleotide
uguauguuacuucuuagagagaaat

SEQ ID NO: 3914 - DNA, 25 bp, Artificial Sequence
  Synthetic Oligonucleotide
auggcugagaagacugacaucautg

SEQ ID NO: 3915 - DNA, 25 bp, Artificial Sequence
  Synthetic Oligonucleotide
caucuuuagugucugaauauaucca

SEQ ID NO: 3916 - DNA, 25 bp, Artificial Sequence
  Synthetic Oligonucleotide
gaaacuuuggcugauaauauugcag

SEQ ID NO: 3917 - DNA, 25 bp, Artificial Sequence
  Synthetic Oligonucleotide
agauguccucgagauacuaaaggaa

SEQ ID NO: 3918 - DNA, 25 bp, Artificial Sequence
  Synthetic Oligonucleotide
caucgacaagacauuggugaggaaa

SEQ ID NO: 3919 - DNA, 25 bp, Artificial Sequence
  Synthetic Oligonucleotide
gaucugacagugcacaauauuuucc

SEQ ID NO: 3920 - DNA, 25 bp, Artificial Sequence
  Synthetic Oligonucleotide
gccugauucacaacuuugagaaggt

SEQ ID NO: 3921 - DNA, 25 bp, Artificial Sequence
  Synthetic Oligonucleotide
cugcauauguggcuaaagcaauaga

SEQ ID NO: 3922 - DNA, 25 bp, Artificial Sequence
  Synthetic Oligonucleotide
ggaaccuuuuagaaagaaauggact

SEQ ID NO: 3923 - DNA, 25 bp, Artificial Sequence
  Synthetic Oligonucleotide
uucaaaguguugguaaugccugatt

SEQ ID NO: 3924 - DNA, 25 bp, Artificial Sequence
  Synthetic Oligonucleotide
gcuguauccuuuaguaaaauuggag

SEQ ID NO: 3925 - DNA, 25 bp, Artificial Sequence
  Synthetic Oligonucleotide
gccacaacucaggaugaaaaauutt

SEQ ID NO: 3926 - DNA, 25 bp, Artificial Sequence
  Synthetic Oligonucleotide
acaucuuuagugucugaauauaucc

SEQ ID NO: 3927 - DNA, 25 bp, Artificial Sequence
  Synthetic Oligonucleotide
gguucaaaguguugguaaugccuga

SEQ ID NO: 3928 - DNA, 25 bp, Artificial Sequence
  Synthetic Oligonucleotide
auuuucuccugaggaaaauuuugga

SEQ ID NO: 3929 - DNA, 25 bp, Artificial Sequence
  Synthetic Oligonucleotide
guuggcugcaacuguauaucuacaa

SEQ ID NO: 3930 - DNA, 25 bp, Artificial Sequence
  Synthetic Oligonucleotide
cuucguuggcugcaacuguauauct

SEQ ID NO: 3931 - DNA, 25 bp, Artificial Sequence
  Synthetic Oligonucleotide
uuuauuucauugcuuuugacuuutc

SEQ ID NO: 3932 - DNA, 25 bp, Artificial Sequence
  Synthetic Oligonucleotide
uauuuucccaucuguauuauuuutt

SEQ ID NO: 3933 - DNA, 25 bp, Artificial Sequence
  Synthetic Oligonucleotide
acaucauugccaauuguugcaaagg

SEQ ID NO: 3934 - DNA, 25 bp, Artificial Sequence
  Synthetic Oligonucleotide
gaaauaaagcauuuuugggaagaat

SEQ ID NO: 3935 - DNA, 25 bp, Artificial Sequence
  Synthetic Oligonucleotide
agucuguaauuccccacuucaauac

SEQ ID NO: 3936 - DNA, 25 bp, Artificial Sequence
  Synthetic Oligonucleotide
ugagaagacugacaucauugccaat

SEQ ID NO: 3937 - DNA, 25 bp, Artificial Sequence
  Synthetic Oligonucleotide
cuuuuccaacaaaauagcaauccct

SEQ ID NO: 3938 - DNA, 25 bp, Artificial Sequence
  Synthetic Oligonucleotide
cacuauugauguucugccagaaatt

SEQ ID NO: 3939 - DNA, 25 bp, Artificial Sequence
  Synthetic Oligonucleotide
acaacaugcuaaaucaguacuucca

SEQ ID NO: 3940 - DNA, 25 bp, Artificial Sequence
  Synthetic Oligonucleotide
cuuuaguaaaauuggagguagcaaa

SEQ ID NO: 3941 - DNA, 25 bp, Artificial Sequence
  Synthetic Oligonucleotide
cuuuugacuuuucaaugggugucct

SEQ ID NO: 3942 - DNA, 25 bp, Artificial Sequence
  Synthetic Oligonucleotide
cuuuuagaaagaaauggacuuucat

SEQ ID NO: 3943 - DNA, 25 bp, Artificial Sequence
  Synthetic Oligonucleotide
aaucacaucuuuagugucugaauat

SEQ ID NO: 3944 - DNA, 25 bp, Artificial Sequence
  Synthetic Oligonucleotide
uauugcagcauuuuccagauggaag

SEQ ID NO: 3945 - DNA, 25 bp, Artificial Sequence
  Synthetic Oligonucleotide
uggcugcaacuguauaucuacaagg

SEQ ID NO: 3946 - DNA, 25 bp, Artificial Sequence
  Synthetic Oligonucleotide
uuacuugacaaagagacacugugca

SEQ ID NO: 3947 - DNA, 25 bp, Artificial Sequence
  Synthetic Oligonucleotide
aucuaucagcugggaagauaucaaa

SEQ ID NO: 3948 - DNA, 25 bp, Artificial Sequence
  Synthetic Oligonucleotide
uuagugucugaauauauccaaaugt

SEQ ID NO: 3949 - DNA, 25 bp, Artificial Sequence
  Synthetic Oligonucleotide
ucacaucuuuagugucugaauauat

SEQ ID NO: 3950 - DNA, 25 bp, Artificial Sequence
  Synthetic Oligonucleotide
aaucccuuuuauuucauugcuuutg

SEQ ID NO: 3951 - DNA, 25 bp, Artificial Sequence
  Synthetic Oligonucleotide
cuuuagugucugaauauauccaaat

SEQ ID NO: 3952 - DNA, 25 bp, Artificial Sequence
  Synthetic Oligonucleotide
uaaccuguauucuguuuacauguct

SEQ ID NO: 3953 - DNA, 25 bp, Artificial Sequence
  Synthetic Oligonucleotide
caucauugccaauuguugcaaaggg

SEQ ID NO: 3954 - DNA, 25 bp, Artificial Sequence
  Synthetic Oligonucleotide
aagggugucguucuuuuccaacaaa

SEQ ID NO: 3955 - DNA, 25 bp, Artificial Sequence
  Synthetic Oligonucleotide
uccucgagauacuaaaggaagaatt

SEQ ID NO: 3956 - DNA, 25 bp, Artificial Sequence
  Synthetic Oligonucleotide
uuacuucuuagagagaaauaaagca

SEQ ID NO: 3957 - DNA, 25 bp, Artificial Sequence
  Synthetic Oligonucleotide
acaaagggugucguucuuuuccaac

SEQ ID NO: 3958 - DNA, 25 bp, Artificial Sequence
  Synthetic Oligonucleotide
aggauguauguuacuucuuagagag

SEQ ID NO: 3959 - DNA, 25 bp, Artificial Sequence
  Synthetic Oligonucleotide
ggcugauaauauugcagcauuuucc

SEQ ID NO: 3960 - DNA, 25 bp, Artificial Sequence
  Synthetic Oligonucleotide
ccaagaucugacagugcacaauatt

SEQ ID NO: 3961 - DNA, 25 bp, Artificial Sequence
  Synthetic Oligonucleotide
aaauggcugagaagacugacaucat

SEQ ID NO: 3962 - DNA, 25 bp, Artificial Sequence
  Synthetic Oligonucleotide
uuccaaagucuauauaugacuauta

SEQ ID NO: 3963 - DNA, 25 bp, Artificial Sequence
  Synthetic Oligonucleotide
agagagaaauaaagcauuuuuggga

SEQ ID NO: 3964 - DNA, 25 bp, Artificial Sequence
  Synthetic Oligonucleotide
uacuucuuagagagaaauaaagcat

SEQ ID NO: 3965 - DNA, 25 bp, Artificial Sequence
  Synthetic Oligonucleotide
ggugccagaaugugaaagucaucga

SEQ ID NO: 3966 - DNA, 25 bp, Artificial Sequence
  Synthetic Oligonucleotide
ucagguucaaaguguugguaaugcc

SEQ ID NO: 3967 - DNA, 25 bp, Artificial Sequence
  Synthetic Oligonucleotide
aagguagcacuggagagaauuggaa

SEQ ID NO: 3968 - DNA, 25 bp, Artificial Sequence
  Synthetic Oligonucleotide
acuaaggugaaaagauaaugauctc

SEQ ID NO: 3969 - DNA, 25 bp, Artificial Sequence
  Synthetic Oligonucleotide
aauauugcagcauuuuccagaugga

SEQ ID NO: 3970 - DNA, 25 bp, Artificial Sequence
  Synthetic Oligonucleotide
agaaauggacuuucauccuggaaat

SEQ ID NO: 3971 - DNA, 25 bp, Artificial Sequence
  Synthetic Oligonucleotide
uuagagagaaauaaagcauuuuugg

SEQ ID NO: 3972 - DNA, 25 bp, Artificial Sequence
  Synthetic Oligonucleotide
ugguucuuaaauuguaagcucaggt

SEQ ID NO: 3973 - DNA, 25 bp, Artificial Sequence
  Synthetic Oligonucleotide
uuaucauuuucuccugaggaaaatt

SEQ ID NO: 3974 - DNA, 25 bp, Artificial Sequence
  Synthetic Oligonucleotide
uacuucuuugaauguagauuuccaa

SEQ ID NO: 3975 - DNA, 25 bp, Artificial Sequence
  Synthetic Oligonucleotide
ucuuaaauuguaagcucagguucaa

SEQ ID NO: 3976 - DNA, 25 bp, Artificial Sequence
  Synthetic Oligonucleotide
augcuaaaucaguacuuccaaagtc

SEQ ID NO: 3977 - DNA, 25 bp, Artificial Sequence
  Synthetic Oligonucleotide
aauguugcugaaacagaucugucga

SEQ ID NO: 3978 - DNA, 25 bp, Artificial Sequence
  Synthetic Oligonucleotide
uguaagcucagguucaaaguguugg

SEQ ID NO: 3979 - DNA, 25 bp, Artificial Sequence
  Synthetic Oligonucleotide
aucugucgacuucuguuuuaggaca

SEQ ID NO: 3980 - DNA, 25 bp, Artificial Sequence
  Synthetic Oligonucleotide
acaaggccauauuugugacagugga

SEQ ID NO: 3981 - DNA, 25 bp, Artificial Sequence
  Synthetic Oligonucleotide
caugucuuuaaaacagugguucuta

SEQ ID NO: 3982 - DNA, 25 bp, Artificial Sequence
  Synthetic Oligonucleotide
aauuccccacuucaauacaaagggt

SEQ ID NO: 3983 - DNA, 25 bp, Artificial Sequence
  Synthetic Oligonucleotide
cuggaugaugugcguaacagauuca

SEQ ID NO: 3984 - DNA, 25 bp, Artificial Sequence
  Synthetic Oligonucleotide
gagguagcaaacacuaaggugaaaa

SEQ ID NO: 3985 - DNA, 25 bp, Artificial Sequence
  Synthetic Oligonucleotide
cuuagagagaaauaaagcauuuutg

SEQ ID NO: 3986 - DNA, 25 bp, Artificial Sequence
  Synthetic Oligonucleotide
guuuuaggauguauguuacuucuta

SEQ ID NO: 3987 - DNA, 25 bp, Artificial Sequence
  Synthetic Oligonucleotide
guccucgagauacuaaaggaagaat

SEQ ID NO: 3988 - DNA, 25 bp, Artificial Sequence
  Synthetic Oligonucleotide
cugauucacaacuuugagaagguag

SEQ ID NO: 3989 - DNA, 25 bp, Artificial Sequence
  Synthetic Oligonucleotide
cuguuuacaugucuuuaaaacagtg

SEQ ID NO: 3990 - DNA, 25 bp, Artificial Sequence
  Synthetic Oligonucleotide
gauaucaaauggcugagaagacuga

SEQ ID NO: 3991 - DNA, 25 bp, Artificial Sequence
  Synthetic Oligonucleotide
uggcugauaauauugcagcauuutc

SEQ ID NO: 3992 - DNA, 25 bp, Artificial Sequence
  Synthetic Oligonucleotide
cagauggaagcuguauccaaggatg

SEQ ID NO: 3993 - DNA, 25 bp, Artificial Sequence
  Synthetic Oligonucleotide
uucguuggcugcaacuguauaucta

SEQ ID NO: 3994 - DNA, 25 bp, Artificial Sequence
  Synthetic Oligonucleotide
agguagcacuggagagaauuggaat

SEQ ID NO: 3995 - DNA, 25 bp, Artificial Sequence
  Synthetic Oligonucleotide
uguugcugaaacagaucugucgact

SEQ ID NO: 3996 - DNA, 25 bp, Artificial Sequence
  Synthetic Oligonucleotide
uuggcugcaacuguauaucuacaag

SEQ ID NO: 3997 - DNA, 25 bp, Artificial Sequence
  Synthetic Oligonucleotide
agaaagaaauggacuuucauccugg

SEQ ID NO: 3998 - DNA, 25 bp, Artificial Sequence
  Synthetic Oligonucleotide
ugcacaauauuuucccaucuguatt

SEQ ID NO: 3999 - DNA, 25 bp, Artificial Sequence
  Synthetic Oligonucleotide
gugcacaauauuuucccaucuguat

SEQ ID NO: 4000 - DNA, 25 bp, Artificial Sequence
  Synthetic Oligonucleotide
uucacaacuuugagaagguagcact

SEQ ID NO: 4001 - DNA, 25 bp, Artificial Sequence
  Synthetic Oligonucleotide
ugcuccggaauguugcugaaacaga

SEQ ID NO: 4002 - DNA, 25 bp, Artificial Sequence
  Synthetic Oligonucleotide
ucaauacaaagggugucguucuutt

SEQ ID NO: 4003 - DNA, 25 bp, Artificial Sequence
  Synthetic Oligonucleotide
caacuguauaucuacaaggaccgag

SEQ ID NO: 4004 - DNA, 25 bp, Artificial Sequence
  Synthetic Oligonucleotide
ugaauguagauuuccaaucacauct

SEQ ID NO: 4005 - DNA, 25 bp, Artificial Sequence
  Synthetic Oligonucleotide
auguauguuacuucuuagagagaaa

SEQ ID NO: 4006 - DNA, 25 bp, Artificial Sequence
  Synthetic Oligonucleotide
uguuuuaggauguauguuacuuctt

SEQ ID NO: 4007 - DNA, 25 bp, Artificial Sequence
  Synthetic Oligonucleotide
ugaugugcguaacagauucaaactg

SEQ ID NO: 4008 - DNA, 25 bp, Artificial Sequence
  Synthetic Oligonucleotide
aguaaaauuggagguagcaaacact

SEQ ID NO: 4009 - DNA, 25 bp, Artificial Sequence
  Synthetic Oligonucleotide
guguucaagauguccucgagauact

SEQ ID NO: 4010 - DNA, 25 bp, Artificial Sequence
  Synthetic Oligonucleotide
acuucuuagagagaaauaaagcatt

SEQ ID NO: 4011 - DNA, 25 bp, Artificial Sequence
  Synthetic Oligonucleotide
acagugcacaauauuuucccauctg

SEQ ID NO: 4012 - DNA, 25 bp, Artificial Sequence
  Synthetic Oligonucleotide
gguguucaagauguccucgagauac

SEQ ID NO: 4013 - DNA, 25 bp, Artificial Sequence
  Synthetic Oligonucleotide
guuacuucuuagagagaaauaaagc

SEQ ID NO: 4014 - DNA, 25 bp, Artificial Sequence
  Synthetic Oligonucleotide
uacaaagggugucguucuuuuccaa

SEQ ID NO: 4015 - DNA, 25 bp, Artificial Sequence
  Synthetic Oligonucleotide
augucuuuaaaacagugguucuuaa

SEQ ID NO: 4016 - DNA, 25 bp, Artificial Sequence
  Synthetic Oligonucleotide
agagggugaccacagucuguaautc

SEQ ID NO: 4017 - DNA, 25 bp, Artificial Sequence
  Synthetic Oligonucleotide
aaggaugcuccggaauguugcugaa

SEQ ID NO: 4018 - DNA, 25 bp, Artificial Sequence
  Synthetic Oligonucleotide
agagaaauaaagcauuuuugggaag

SEQ ID NO: 4019 - DNA, 25 bp, Artificial Sequence
  Synthetic Oligonucleotide
uuugaauguagauuuccaaucacat

SEQ ID NO: 4020 - DNA, 25 bp, Artificial Sequence
  Synthetic Oligonucleotide
guuuacaugucuuuaaaacaguggt

SEQ ID NO: 4021 - DNA, 25 bp, Artificial Sequence
  Synthetic Oligonucleotide
uuggagguagcaaacacuaagguga

SEQ ID NO: 4022 - DNA, 25 bp, Artificial Sequence
  Synthetic Oligonucleotide
aaagcaauagacccaucuaucagct

SEQ ID NO: 4023 - DNA, 25 bp, Artificial Sequence
  Synthetic Oligonucleotide
acaugcuaaaucaguacuuccaaag

SEQ ID NO: 4024 - DNA, 25 bp, Artificial Sequence
  Synthetic Oligonucleotide
cuucuuugaauguagauuuccaatc

SEQ ID NO: 4025 - DNA, 25 bp, Artificial Sequence
  Synthetic Oligonucleotide
ccaauuguugcaaagggcauuuuga

SEQ ID NO: 4026 - DNA, 25 bp, Artificial Sequence
  Synthetic Oligonucleotide
cuaaagugcuguauccuuuaguaaa

SEQ ID NO: 4027 - DNA, 25 bp, Artificial Sequence
  Synthetic Oligonucleotide
auuacuugacaaagagacacugugc

SEQ ID NO: 4028 - DNA, 25 bp, Artificial Sequence
  Synthetic Oligonucleotide
uucuuaaauuguaagcucagguuca

SEQ ID NO: 4029 - DNA, 25 bp, Artificial Sequence
  Synthetic Oligonucleotide
aaacagaucugucgacuucuguutt

SEQ ID NO: 4030 - DNA, 25 bp, Artificial Sequence
  Synthetic Oligonucleotide
uaauauugcagcauuuuccagaugg

SEQ ID NO: 4031 - DNA, 25 bp, Artificial Sequence
  Synthetic Oligonucleotide
gauucacaacuuugagaagguagca

SEQ ID NO: 4032 - DNA, 25 bp, Artificial Sequence
  Synthetic Oligonucleotide
gcauauguggcuaaagcaauagacc

SEQ ID NO: 4033 - DNA, 25 bp, Artificial Sequence
  Synthetic Oligonucleotide
gggugucguucuuuuccaacaaaat

SEQ ID NO: 4034 - DNA, 25 bp, Artificial Sequence
  Synthetic Oligonucleotide
ccgucuggaugaugugcguaacaga

SEQ ID NO: 4035 - DNA, 25 bp, Artificial Sequence
  Synthetic Oligonucleotide
uaggaaccuuuuagaaagaaaugga

SEQ ID NO: 4036 - DNA, 25 bp, Artificial Sequence
  Synthetic Oligonucleotide
gccacuauugauguucugccagaaa

SEQ ID NO: 4037 - DNA, 25 bp, Artificial Sequence
  Synthetic Oligonucleotide
caauacaaagggugucguucuuutc

SEQ ID NO: 4038 - DNA, 25 bp, Artificial Sequence
  Synthetic Oligonucleotide
ucuuugaauguagauuuccaaucac

SEQ ID NO: 4039 - DNA, 25 bp, Artificial Sequence
  Synthetic Oligonucleotide
ucguuggcugcaacuguauaucuac

SEQ ID NO: 4040 - DNA, 25 bp, Artificial Sequence
  Synthetic Oligonucleotide
gcaauaaccugugaaaaugcucccc

SEQ ID NO: 4041 - DNA, 25 bp, Artificial Sequence
  Synthetic Oligonucleotide
agucuauauaugacuauuacaggtc

SEQ ID NO: 4042 - DNA, 25 bp, Artificial Sequence
  Synthetic Oligonucleotide
cauuuucuccugaggaaaauuuugg

SEQ ID NO: 4043 - DNA, 25 bp, Artificial Sequence
  Synthetic Oligonucleotide
cauauguggcuaaagcaauagaccc

SEQ ID NO: 4044 - DNA, 25 bp, Artificial Sequence
  Synthetic Oligonucleotide
cgacaguggacuugcugcauaugtg

SEQ ID NO: 4045 - DNA, 25 bp, Artificial Sequence
  Synthetic Oligonucleotide
uuccaagaucugacagugcacaata

SEQ ID NO: 4046 - DNA, 25 bp, Artificial Sequence
  Synthetic Oligonucleotide
augaugaagaaacuuuggcugauaa

SEQ ID NO: 4047 - DNA, 25 bp, Artificial Sequence
  Synthetic Oligonucleotide
gagggugaccacagucuguaauucc

SEQ ID NO: 4048 - DNA, 25 bp, Artificial Sequence
  Synthetic Oligonucleotide
agaaauaaagcauuuuugggaagaa

SEQ ID NO: 4049 - DNA, 25 bp, Artificial Sequence
  Synthetic Oligonucleotide
gaaugggaucuuggugucgaaucat

SEQ ID NO: 4050 - DNA, 25 bp, Artificial Sequence
  Synthetic Oligonucleotide
guaauuccccacuucaauacaaagg

SEQ ID NO: 4051 - DNA, 25 bp, Artificial Sequence
  Synthetic Oligonucleotide
cuguauccuuuaguaaaauuggagg

SEQ ID NO: 4052 - DNA, 25 bp, Artificial Sequence
  Synthetic Oligonucleotide
gaagguagcacuggagagaauugga

SEQ ID NO: 4053 - DNA, 25 bp, Artificial Sequence
  Synthetic Oligonucleotide
agccacuauugauguucugccagaa

SEQ ID NO: 4054 - DNA, 25 bp, Artificial Sequence
  Synthetic Oligonucleotide
gacagugcacaauauuuucccauct

SEQ ID NO: 4055 - DNA, 25 bp, Artificial Sequence
  Synthetic Oligonucleotide
uccuaggaaccuuuuagaaagaaat

SEQ ID NO: 4056 - DNA, 25 bp, Artificial Sequence
  Synthetic Oligonucleotide
aaugggaucuuggugucgaaucatg

SEQ ID NO: 4057 - DNA, 25 bp, Artificial Sequence
  Synthetic Oligonucleotide
agggugaccacagucuguaauuccc

SEQ ID NO: 4058 - DNA, 25 bp, Artificial Sequence
  Synthetic Oligonucleotide
aucugacagugcacaauauuuuccc

SEQ ID NO: 4059 - DNA, 25 bp, Artificial Sequence
  Synthetic Oligonucleotide
acuuccaaagucuauauaugacuat

SEQ ID NO: 4060 - DNA, 25 bp, Artificial Sequence
  Synthetic Oligonucleotide
uagaaagaaauggacuuucaucctg

SEQ ID NO: 4061 - DNA, 25 bp, Artificial Sequence
  Synthetic Oligonucleotide
gugggugccagaaugugaaagucat

SEQ ID NO: 4062 - DNA, 25 bp, Artificial Sequence
  Synthetic Oligonucleotide
gaggaaaauuuuggagacgacagtg

SEQ ID NO: 4063 - DNA, 25 bp, Artificial Sequence
  Synthetic Oligonucleotide
gggugccagccacuauugauguuct

SEQ ID NO: 4064 - DNA, 25 bp, Artificial Sequence
  Synthetic Oligonucleotide
ccggcuaauuuguaucaaugauuat

SEQ ID NO: 4065 - DNA, 25 bp, Artificial Sequence
  Synthetic Oligonucleotide
cagagggugaccacagucuguaatt

SEQ ID NO: 4066 - DNA, 25 bp, Artificial Sequence
  Synthetic Oligonucleotide
aaggccauauuugugacaguggaca

SEQ ID NO: 4067 - DNA, 25 bp, Artificial Sequence
  Synthetic Oligonucleotide
cuuuaaaacagugguucuuaaautg

SEQ ID NO: 4068 - DNA, 25 bp, Artificial Sequence
  Synthetic Oligonucleotide
cucgagauacuaaaggaagaauucc

SEQ ID NO: 4069 - DNA, 25 bp, Artificial Sequence
  Synthetic Oligonucleotide
agcaauagacccaucuaucagcugg

SEQ ID NO: 4070 - DNA, 25 bp, Artificial Sequence
  Synthetic Oligonucleotide
auuuuccagauggaagcuguaucca

SEQ ID NO: 4071 - DNA, 25 bp, Artificial Sequence
  Synthetic Oligonucleotide
ugcuaaaucaguacuuccaaaguct

SEQ ID NO: 4072 - DNA, 25 bp, Artificial Sequence
  Synthetic Oligonucleotide
uuuuagaaagaaauggacuuucatc

SEQ ID NO: 4073 - DNA, 25 bp, Artificial Sequence
  Synthetic Oligonucleotide
uacuuuaucauuuucuccugaggaa

SEQ ID NO: 4074 - DNA, 25 bp, Artificial Sequence
  Synthetic Oligonucleotide
aaaucaguacuuccaaagucuauat

SEQ ID NO: 4075 - DNA, 25 bp, Artificial Sequence
  Synthetic Oligonucleotide
cagaucugucgacuucuguuuuagg

SEQ ID NO: 4076 - DNA, 25 bp, Artificial Sequence
  Synthetic Oligonucleotide
gacauuggugaggaaaaauccuutg

SEQ ID NO: 4077 - DNA, 25 bp, Artificial Sequence
  Synthetic Oligonucleotide
uccaacaaaauagcaaucccuuuta

SEQ ID NO: 4078 - DNA, 25 bp, Artificial Sequence
  Synthetic Oligonucleotide
acagaucugucgacuucuguuuuag

SEQ ID NO: 4079 - DNA, 25 bp, Artificial Sequence
  Synthetic Oligonucleotide
acuguauaucuacaaggaccgagaa

SEQ ID NO: 4080 - DNA, 25 bp, Artificial Sequence
  Synthetic Oligonucleotide
ugauucacaacuuugagaagguagc

SEQ ID NO: 4081 - DNA, 25 bp, Artificial Sequence
  Synthetic Oligonucleotide
aacuuuggcugauaauauugcagca

SEQ ID NO: 4082 - DNA, 25 bp, Artificial Sequence
  Synthetic Oligonucleotide
ccaaucacaucuuuagugucugaat

SEQ ID NO: 4083 - DNA, 25 bp, Artificial Sequence
  Synthetic Oligonucleotide
gcuccggaauguugcugaaacagat

SEQ ID NO: 4084 - DNA, 25 bp, Artificial Sequence
  Synthetic Oligonucleotide
uaauuccccacuucaauacaaaggg

SEQ ID NO: 4085 - DNA, 25 bp, Artificial Sequence
  Synthetic Oligonucleotide
accuuuuagaaagaaauggacuutc

SEQ ID NO: 4086 - DNA, 25 bp, Artificial Sequence
  Synthetic Oligonucleotide
uguucaagauguccucgagauacta

SEQ ID NO: 4087 - DNA, 25 bp, Artificial Sequence
  Synthetic Oligonucleotide
auuccccacuucaauacaaagggtg

SEQ ID NO: 4088 - DNA, 25 bp, Artificial Sequence
  Synthetic Oligonucleotide
gcugcaacuguauaucuacaaggac

SEQ ID NO: 4089 - DNA, 25 bp, Artificial Sequence
  Synthetic Oligonucleotide
gucuuuaaaacagugguucuuaaat

SEQ ID NO: 4090 - DNA, 25 bp, Artificial Sequence
  Synthetic Oligonucleotide
acagagggucagcaugccaauaugt

SEQ ID NO: 4091 - DNA, 25 bp, Artificial Sequence
  Synthetic Oligonucleotide
gauguccucgagauacuaaaggaag

SEQ ID NO: 4092 - DNA, 25 bp, Artificial Sequence
  Synthetic Oligonucleotide
gcgguaauuggugauacuucuuuga

SEQ ID NO: 4093 - DNA, 25 bp, Artificial Sequence
  Synthetic Oligonucleotide
ucuuagagagaaauaaagcauuutt

SEQ ID NO: 4094 - DNA, 25 bp, Artificial Sequence
  Synthetic Oligonucleotide
aaaauuggagguagcaaacacuaag

SEQ ID NO: 4095 - DNA, 25 bp, Artificial Sequence
  Synthetic Oligonucleotide
ucuuuaaaacagugguucuuaaatt

SEQ ID NO: 4096 - DNA, 25 bp, Artificial Sequence
  Synthetic Oligonucleotide
ggauguauguuacuucuuagagaga

SEQ ID NO: 4097 - DNA, 25 bp, Artificial Sequence
  Synthetic Oligonucleotide
guauccuuuaguaaaauuggaggta

SEQ ID NO: 4098 - DNA, 25 bp, Artificial Sequence
  Synthetic Oligonucleotide
gcauuuuccagauggaagcuguatc

SEQ ID NO: 4099 - DNA, 25 bp, Artificial Sequence
  Synthetic Oligonucleotide
acaacuuugagaagguagcacugga

SEQ ID NO: 4100 - DNA, 25 bp, Artificial Sequence
  Synthetic Oligonucleotide
ucuuuuccaacaaaauagcaauccc

SEQ ID NO: 4101 - DNA, 25 bp, Artificial Sequence
  Synthetic Oligonucleotide
gagugggugccagaaugugaaagtc

SEQ ID NO: 4102 - DNA, 25 bp, Artificial Sequence
  Synthetic Oligonucleotide
ucaaauggcugagaagacugacatc

SEQ ID NO: 4103 - DNA, 25 bp, Artificial Sequence
  Synthetic Oligonucleotide
ccgccacaacucaggaugaaaaatt

SEQ ID NO: 4104 - DNA, 25 bp, Artificial Sequence
  Synthetic Oligonucleotide
ggaugcuccggaauguugcugaaac

SEQ ID NO: 4105 - DNA, 25 bp, Artificial Sequence
  Synthetic Oligonucleotide
agguagcaaacacuaaggugaaaag

SEQ ID NO: 4106 - DNA, 25 bp, Artificial Sequence
  Synthetic Oligonucleotide
acagucuguaauuccccacuucaat

SEQ ID NO: 4107 - DNA, 25 bp, Artificial Sequence
  Synthetic Oligonucleotide
auguugcugaaacagaucugucgac

SEQ ID NO: 4108 - DNA, 25 bp, Artificial Sequence
  Synthetic Oligonucleotide
uaaaucaguacuuccaaagucuata

SEQ ID NO: 4109 - DNA, 25 bp, Artificial Sequence
  Synthetic Oligonucleotide
aacuguauaucuacaaggaccgaga

SEQ ID NO: 4110 - DNA, 25 bp, Artificial Sequence
  Synthetic Oligonucleotide
caugcuaaaucaguacuuccaaagt

SEQ ID NO: 4111 - DNA, 25 bp, Artificial Sequence
  Synthetic Oligonucleotide
auaucaaauggcugagaagacugac

SEQ ID NO: 4112 - DNA, 25 bp, Artificial Sequence
  Synthetic Oligonucleotide
cuucuuagagagaaauaaagcautt

SEQ ID NO: 4113 - DNA, 25 bp, Artificial Sequence
  Synthetic Oligonucleotide
cgucuggaugaugugcguaacagat

SEQ ID NO: 4114 - DNA, 25 bp, Artificial Sequence
  Synthetic Oligonucleotide
gccaauuguugcaaagggcauuutg

SEQ ID NO: 4115 - DNA, 25 bp, Artificial Sequence
  Synthetic Oligonucleotide
caaagggugucguucuuuuccaaca

SEQ ID NO: 4116 - DNA, 25 bp, Artificial Sequence
  Synthetic Oligonucleotide
ucaucgacaagacauuggugaggaa

SEQ ID NO: 4117 - DNA, 25 bp, Artificial Sequence
  Synthetic Oligonucleotide
uuuggcugauaauauugcagcautt

SEQ ID NO: 4118 - DNA, 25 bp, Artificial Sequence
  Synthetic Oligonucleotide
cuugcugcauauguggcuaaagcaa

SEQ ID NO: 4119 - DNA, 25 bp, Artificial Sequence
  Synthetic Oligonucleotide
uuuuccaacaaaauagcaauccctt

SEQ ID NO: 4120 - DNA, 25 bp, Artificial Sequence
  Synthetic Oligonucleotide
cacuucaauacaaagggugucgutc

SEQ ID NO: 4121 - DNA, 25 bp, Artificial Sequence
  Synthetic Oligonucleotide
uauccaaauguuuuaggauguaugt

SEQ ID NO: 4122 - DNA, 25 bp, Artificial Sequence
  Synthetic Oligonucleotide
ucuaucagcugggaagauaucaaat

SEQ ID NO: 4123 - DNA, 25 bp, Artificial Sequence
  Synthetic Oligonucleotide
gacaguggacuugcugcauaugugg

SEQ ID NO: 4124 - DNA, 25 bp, Artificial Sequence
  Synthetic Oligonucleotide
guccuaggaaccuuuuagaaagaaa

SEQ ID NO: 4125 - DNA, 25 bp, Artificial Sequence
  Synthetic Oligonucleotide
ccacagucuguaauuccccacuuca

SEQ ID NO: 4126 - DNA, 25 bp, Artificial Sequence
  Synthetic Oligonucleotide
accgucuggaugaugugcguaacag

SEQ ID NO: 4127 - DNA, 25 bp, Artificial Sequence
  Synthetic Oligonucleotide
cugcaacuguauaucuacaaggacc

SEQ ID NO: 4128 - DNA, 25 bp, Artificial Sequence
  Synthetic Oligonucleotide
caaggaugcuccggaauguugcuga

SEQ ID NO: 4129 - DNA, 25 bp, Artificial Sequence
  Synthetic Oligonucleotide
aggaugcuccggaauguugcugaaa

SEQ ID NO: 4130 - DNA, 25 bp, Artificial Sequence
  Synthetic Oligonucleotide
guugcugaaacagaucugucgactt

SEQ ID NO: 4131 - DNA, 25 bp, Artificial Sequence
  Synthetic Oligonucleotide
aagggcauuuugagaggugaugatg

SEQ ID NO: 4132 - DNA, 25 bp, Artificial Sequence
  Synthetic Oligonucleotide
uaaagcaauagacccaucuaucagc

SEQ ID NO: 4133 - DNA, 25 bp, Artificial Sequence
  Synthetic Oligonucleotide
caagauguccucgagauacuaaagg

SEQ ID NO: 4134 - DNA, 25 bp, Artificial Sequence
  Synthetic Oligonucleotide
gaccacagucuguaauuccccactt

SEQ ID NO: 4135 - DNA, 25 bp, Artificial Sequence
  Synthetic Oligonucleotide
aagucaucgacaagacauuggugag

SEQ ID NO: 4136 - DNA, 25 bp, Artificial Sequence
  Synthetic Oligonucleotide
ggaagauaucaaauggcugagaaga

SEQ ID NO: 4137 - DNA, 25 bp, Artificial Sequence
  Synthetic Oligonucleotide
ccugaggaaaauuuuggagacgaca

SEQ ID NO: 4138 - DNA, 25 bp, Artificial Sequence
  Synthetic Oligonucleotide
gauguucugccagaaauuguggagg

SEQ ID NO: 4139 - DNA, 25 bp, Artificial Sequence
  Synthetic Oligonucleotide
ccagccacuauugauguucugccag

SEQ ID NO: 4140 - DNA, 25 bp, Artificial Sequence
  Synthetic Oligonucleotide
aaagggugucguucuuuuccaacaa

SEQ ID NO: 4141 - DNA, 25 bp, Artificial Sequence
  Synthetic Oligonucleotide
ucgacaagacauuggugaggaaaaa

SEQ ID NO: 4142 - DNA, 25 bp, Artificial Sequence
  Synthetic Oligonucleotide
aaaggcacugauguucugaaagctc

SEQ ID NO: 4143 - DNA, 25 bp, Artificial Sequence
  Synthetic Oligonucleotide
ggugaccacagucuguaauucccca

SEQ ID NO: 4144 - DNA, 25 bp, Artificial Sequence
  Synthetic Oligonucleotide
cgccacaacucaggaugaaaaautt

SEQ ID NO: 4145 - DNA, 25 bp, Artificial Sequence
  Synthetic Oligonucleotide
ggcgguaauuggugauacuucuutg

SEQ ID NO: 4146 - DNA, 25 bp, Artificial Sequence
  Synthetic Oligonucleotide
ugcuuuugacuuuucaaugggugtc

SEQ ID NO: 4147 - DNA, 25 bp, Artificial Sequence
  Synthetic Oligonucleotide
auggguguccuaggaaccuuuuaga

SEQ ID NO: 4148 - DNA, 25 bp, Artificial Sequence
  Synthetic Oligonucleotide
uggagguagcaaacacuaaggugaa

SEQ ID NO: 4149 - DNA, 25 bp, Artificial Sequence
  Synthetic Oligonucleotide
ugaaacagaucugucgacuucugtt

SEQ ID NO: 4150 - DNA, 25 bp, Artificial Sequence
  Synthetic Oligonucleotide
caaggccauauuugugacaguggac

SEQ ID NO: 4151 - DNA, 25 bp, Artificial Sequence
  Synthetic Oligonucleotide
ugcagcauuuuccagauggaagctg

SEQ ID NO: 4152 - DNA, 25 bp, Artificial Sequence
  Synthetic Oligonucleotide
cuaaaucaguacuuccaaagucuat

SEQ ID NO: 4153 - DNA, 25 bp, Artificial Sequence
  Synthetic Oligonucleotide
gugguucuuaaauuguaagcucagg

SEQ ID NO: 4154 - DNA, 25 bp, Artificial Sequence
  Synthetic Oligonucleotide
uugcuuuugacuuuucaaugggugt

SEQ ID NO: 4155 - DNA, 25 bp, Artificial Sequence
  Synthetic Oligonucleotide
gagaaauaaagcauuuuugggaaga

SEQ ID NO: 4156 - DNA, 25 bp, Artificial Sequence
  Synthetic Oligonucleotide
guagauuuccaaucacaucuuuagt

SEQ ID NO: 4157 - DNA, 25 bp, Artificial Sequence
  Synthetic Oligonucleotide
ccagauggaagcuguauccaaggat

SEQ ID NO: 4158 - DNA, 25 bp, Artificial Sequence
  Synthetic Oligonucleotide
auuguugcaaagggcauuuugagag

SEQ ID NO: 4159 - DNA, 25 bp, Artificial Sequence
  Synthetic Oligonucleotide
cuacaaggaccgagaagucaccaag

SEQ ID NO: 4160 - DNA, 25 bp, Artificial Sequence
  Synthetic Oligonucleotide
ugagaagguagcacuggagagaatt

SEQ ID NO: 4161 - DNA, 25 bp, Artificial Sequence
  Synthetic Oligonucleotide
ggagguagcaaacacuaaggugaaa

SEQ ID NO: 4162 - DNA, 25 bp, Artificial Sequence
  Synthetic Oligonucleotide
aaggaccgagaagucaccaagaagc

SEQ ID NO: 4163 - DNA, 25 bp, Artificial Sequence
  Synthetic Oligonucleotide
cuacaaggccauauuugugacagtg

SEQ ID NO: 4164 - DNA, 25 bp, Artificial Sequence
  Synthetic Oligonucleotide
aguacuuuaucauuuucuccugagg

SEQ ID NO: 4165 - DNA, 25 bp, Artificial Sequence
  Synthetic Oligonucleotide
gauuuccaaucacaucuuuagugtc

SEQ ID NO: 4166 - DNA, 25 bp, Artificial Sequence
  Synthetic Oligonucleotide
uaggauguauguuacuucuuagaga

SEQ ID NO: 4167 - DNA, 25 bp, Artificial Sequence
  Synthetic Oligonucleotide
uuuaucauuuucuccugaggaaaat

SEQ ID NO: 4168 - DNA, 25 bp, Artificial Sequence
  Synthetic Oligonucleotide
ucuggaugaugugcguaacagautc

SEQ ID NO: 4169 - DNA, 25 bp, Artificial Sequence
  Synthetic Oligonucleotide
uguauaucuacaaggaccgagaagt

SEQ ID NO: 4170 - DNA, 25 bp, Artificial Sequence
  Synthetic Oligonucleotide
aaugaugaagaaacuuuggcugata

SEQ ID NO: 4171 - DNA, 25 bp, Artificial Sequence
  Synthetic Oligonucleotide
gaucugucgacuucuguuuuaggac

SEQ ID NO: 4172 - DNA, 25 bp, Artificial Sequence
  Synthetic Oligonucleotide
gguagcacuggagagaauuggaatg

SEQ ID NO: 4173 - DNA, 25 bp, Artificial Sequence
  Synthetic Oligonucleotide
aagaaauggacuuucauccuggaaa

SEQ ID NO: 4174 - DNA, 25 bp, Artificial Sequence
  Synthetic Oligonucleotide
aaggcacugauguucugaaagcuct

SEQ ID NO: 4175 - DNA, 25 bp, Artificial Sequence
  Synthetic Oligonucleotide
uggcugagaagacugacaucauugc

SEQ ID NO: 4176 - DNA, 25 bp, Artificial Sequence
  Synthetic Oligonucleotide
cagccacuauugauguucugccaga

SEQ ID NO: 4177 - DNA, 25 bp, Artificial Sequence
  Synthetic Oligonucleotide
gcaacuguauaucuacaaggaccga

SEQ ID NO: 4178 - DNA, 25 bp, Artificial Sequence
  Synthetic Oligonucleotide
aaagguguucaagauguccucgaga

SEQ ID NO: 4179 - DNA, 25 bp, Artificial Sequence
  Synthetic Oligonucleotide
uuuuaggauguauguuacuucuuag

SEQ ID NO: 4180 - DNA, 25 bp, Artificial Sequence
  Synthetic Oligonucleotide
gguguccuaggaaccuuuuagaaag

SEQ ID NO: 4181 - DNA, 25 bp, Artificial Sequence
  Synthetic Oligonucleotide
aacagaucugucgacuucuguuuta

SEQ ID NO: 4182 - DNA, 25 bp, Artificial Sequence
  Synthetic Oligonucleotide
aagauaucaaauggcugagaagact

SEQ ID NO: 4183 - DNA, 25 bp, Artificial Sequence
  Synthetic Oligonucleotide
auugcagcauuuuccagauggaagc

SEQ ID NO: 4184 - DNA, 25 bp, Artificial Sequence
  Synthetic Oligonucleotide
aauacaaagggugucguucuuuucc

SEQ ID NO: 4185 - DNA, 25 bp, Artificial Sequence
  Synthetic Oligonucleotide
acuuuucaauggguguccuaggaac

SEQ ID NO: 4186 - DNA, 25 bp, Artificial Sequence
  Synthetic Oligonucleotide
gcuuuugacuuuucaaugggugucc

SEQ ID NO: 4187 - DNA, 25 bp, Artificial Sequence
  Synthetic Oligonucleotide
uugcugaaacagaucugucgacutc

SEQ ID NO: 4188 - DNA, 25 bp, Artificial Sequence
  Synthetic Oligonucleotide
gaauguugcugaaacagaucugucg

SEQ ID NO: 4189 - DNA, 25 bp, Artificial Sequence
  Synthetic Oligonucleotide
gcuaaagugcuguauccuuuaguaa

SEQ ID NO: 4190 - DNA, 25 bp, Artificial Sequence
  Synthetic Oligonucleotide
ggcuaaagugcuguauccuuuagta

SEQ ID NO: 4191 - DNA, 25 bp, Artificial Sequence
  Synthetic Oligonucleotide
gagaagguagcacuggagagaautg

SEQ ID NO: 4192 - DNA, 25 bp, Artificial Sequence
  Synthetic Oligonucleotide
ggcuaaagcaauagacccaucuatc

SEQ ID NO: 4193 - DNA, 25 bp, Artificial Sequence
  Synthetic Oligonucleotide
aauuguugcaaagggcauuuugaga

SEQ ID NO: 4194 - DNA, 25 bp, Artificial Sequence
  Synthetic Oligonucleotide
uaguaaaauuggagguagcaaacac

SEQ ID NO: 4195 - DNA, 25 bp, Artificial Sequence
  Synthetic Oligonucleotide
uauaucuacaaggaccgagaaguca

SEQ ID NO: 4196 - DNA, 25 bp, Artificial Sequence
  Synthetic Oligonucleotide
uauguggcuaaagcaauagacccat

SEQ ID NO: 4197 - DNA, 25 bp, Artificial Sequence
  Synthetic Oligonucleotide
auuggagguagcaaacacuaaggtg

SEQ ID NO: 4198 - DNA, 25 bp, Artificial Sequence
  Synthetic Oligonucleotide
auaucuacaaggaccgagaagucac

SEQ ID NO: 4199 - DNA, 25 bp, Artificial Sequence
  Synthetic Oligonucleotide
guggacuugcugcauauguggcuaa

SEQ ID NO: 4200 - DNA, 25 bp, Artificial Sequence
  Synthetic Oligonucleotide
uauccuuuaguaaaauuggagguag

SEQ ID NO: 4201 - DNA, 25 bp, Artificial Sequence
  Synthetic Oligonucleotide
uacuugacaaagagacacugugcag

SEQ ID NO: 4202 - DNA, 25 bp, Artificial Sequence
  Synthetic Oligonucleotide
gacuuuucaauggguguccuaggaa

SEQ ID NO: 4203 - DNA, 25 bp, Artificial Sequence
  Synthetic Oligonucleotide
uuagaaagaaauggacuuucaucct

SEQ ID NO: 4204 - DNA, 25 bp, Artificial Sequence
  Synthetic Oligonucleotide
augcuccggaauguugcugaaacag

SEQ ID NO: 4205 - DNA, 25 bp, Artificial Sequence
  Synthetic Oligonucleotide
gaaagaaauggacuuucauccugga

SEQ ID NO: 4206 - DNA, 25 bp, Artificial Sequence
  Synthetic Oligonucleotide
uuuacaugucuuuaaaacaguggtt

SEQ ID NO: 4207 - DNA, 25 bp, Artificial Sequence
  Synthetic Oligonucleotide
ugaugaagaaacuuuggcugauaat

SEQ ID NO: 4208 - DNA, 25 bp, Artificial Sequence
  Synthetic Oligonucleotide
acgacaguggacuugcugcauaugt

SEQ ID NO: 4209 - DNA, 25 bp, Artificial Sequence
  Synthetic Oligonucleotide
agaucugucgacuucuguuuuagga

SEQ ID NO: 4210 - DNA, 25 bp, Artificial Sequence
  Synthetic Oligonucleotide
auguggcuaaagcaauagacccatc

SEQ ID NO: 4211 - DNA, 25 bp, Artificial Sequence
  Synthetic Oligonucleotide
cggaaaggcacugauguucugaaag

SEQ ID NO: 4212 - DNA, 25 bp, Artificial Sequence
  Synthetic Oligonucleotide
ugcauauguggcuaaagcaauagac

SEQ ID NO: 4213 - DNA, 25 bp, Artificial Sequence
  Synthetic Oligonucleotide
gagacgacaguggacuugcugcata

SEQ ID NO: 4214 - DNA, 25 bp, Artificial Sequence
  Synthetic Oligonucleotide
gcagagggugaccacagucuguaat

SEQ ID NO: 4215 - DNA, 25 bp, Artificial Sequence
  Synthetic Oligonucleotide
uuuagugucugaauauauccaaatg

SEQ ID NO: 4216 - DNA, 25 bp, Artificial Sequence
  Synthetic Oligonucleotide
ucaagauguccucgagauacuaaag

SEQ ID NO: 4217 - DNA, 25 bp, Artificial Sequence
  Synthetic Oligonucleotide
uaaaauuggagguagcaaacacuaa

SEQ ID NO: 4218 - DNA, 25 bp, Artificial Sequence
  Synthetic Oligonucleotide
ucacaacuuugagaagguagcactg

SEQ ID NO: 4219 - DNA, 25 bp, Artificial Sequence
  Synthetic Oligonucleotide
uaucaaauggcugagaagacugaca

SEQ ID NO: 4220 - DNA, 25 bp, Artificial Sequence
  Synthetic Oligonucleotide
agaaagguguucaagauguccucga

SEQ ID NO: 4221 - DNA, 25 bp, Artificial Sequence
  Synthetic Oligonucleotide
agauuuccaaucacaucuuuagugt

SEQ ID NO: 4222 - DNA, 25 bp, Artificial Sequence
  Synthetic Oligonucleotide
uugaauguagauuuccaaucacatc

SEQ ID NO: 4223 - DNA, 25 bp, Artificial Sequence
  Synthetic Oligonucleotide
uugcagcauuuuccagauggaagct

SEQ ID NO: 4224 - DNA, 25 bp, Artificial Sequence
  Synthetic Oligonucleotide
ccacuucaauacaaagggugucgtt

SEQ ID NO: 4225 - DNA, 25 bp, Artificial Sequence
  Synthetic Oligonucleotide
uucuuugaauguagauuuccaauca

SEQ ID NO: 4226 - DNA, 25 bp, Artificial Sequence
  Synthetic Oligonucleotide
uugcugcauauguggcuaaagcaat

SEQ ID NO: 4227 - DNA, 25 bp, Artificial Sequence
  Synthetic Oligonucleotide
uggguguccuaggaaccuuuuagaa

SEQ ID NO: 4228 - DNA, 25 bp, Artificial Sequence
  Synthetic Oligonucleotide
cuaaagcaauagacccaucuaucag

SEQ ID NO: 4229 - DNA, 25 bp, Artificial Sequence
  Synthetic Oligonucleotide
gagauacuaaaggaagaauuccggt

SEQ ID NO: 4230 - DNA, 25 bp, Artificial Sequence
  Synthetic Oligonucleotide
ugcggaaaggcacugauguucugaa

SEQ ID NO: 4231 - DNA, 25 bp, Artificial Sequence
  Synthetic Oligonucleotide
uuaggauguauguuacuucuuagag

SEQ ID NO: 4232 - DNA, 25 bp, Artificial Sequence
  Synthetic Oligonucleotide
ggaaaauuuuggagacgacagugga

SEQ ID NO: 4233 - DNA, 25 bp, Artificial Sequence
  Synthetic Oligonucleotide
uuuaguaaaauuggagguagcaaac

SEQ ID NO: 4234 - DNA, 25 bp, Artificial Sequence
  Synthetic Oligonucleotide
gacagagggucagcaugccaauatg

SEQ ID NO: 4235 - DNA, 25 bp, Artificial Sequence
  Synthetic Oligonucleotide
ugucgacuucuguuuuaggacagag

SEQ ID NO: 4236 - DNA, 25 bp, Artificial Sequence
  Synthetic Oligonucleotide
uuuaggauguauguuacuucuuaga

SEQ ID NO: 4237 - DNA, 25 bp, Artificial Sequence
  Synthetic Oligonucleotide
agcacuggagagaauuggaaugggt

SEQ ID NO: 4238 - DNA, 25 bp, Artificial Sequence
  Synthetic Oligonucleotide
aauuggagguagcaaacacuaaggt

SEQ ID NO: 4239 - DNA, 25 bp, Artificial Sequence
  Synthetic Oligonucleotide
ggcugagaagacugacaucauugcc

SEQ ID NO: 4240 - DNA, 25 bp, Artificial Sequence
  Synthetic Oligonucleotide
uccaaucacaucuuuagugucugaa

SEQ ID NO: 4241 - DNA, 25 bp, Artificial Sequence
  Synthetic Oligonucleotide
uucaauacaaagggugucguucutt

SEQ ID NO: 4242 - DNA, 25 bp, Artificial Sequence
  Synthetic Oligonucleotide
guauaucuacaaggaccgagaagtc

SEQ ID NO: 4243 - DNA, 25 bp, Artificial Sequence
  Synthetic Oligonucleotide
acuugcugcauauguggcuaaagca

SEQ ID NO: 4244 - DNA, 25 bp, Artificial Sequence
  Synthetic Oligonucleotide
acuuuggcugauaauauugcagcat

SEQ ID NO: 4245 - DNA, 25 bp, Artificial Sequence
  Synthetic Oligonucleotide
auuuuggagacgacaguggacuugc

SEQ ID NO: 4246 - DNA, 25 bp, Artificial Sequence
  Synthetic Oligonucleotide
cugucgacuucuguuuuaggacaga

SEQ ID NO: 4247 - DNA, 25 bp, Artificial Sequence
  Synthetic Oligonucleotide
cuggggcaaaugaugaagaaacutt

SEQ ID NO: 4248 - DNA, 25 bp, Artificial Sequence
  Synthetic Oligonucleotide
cuccugaggaaaauuuuggagacga

SEQ ID NO: 4249 - DNA, 25 bp, Artificial Sequence
  Synthetic Oligonucleotide
uggcuaaagcaauagacccaucuat

SEQ ID NO: 4250 - DNA, 25 bp, Artificial Sequence
  Synthetic Oligonucleotide
cagagggucagcaugccaauaugtg

SEQ ID NO: 4251 - DNA, 25 bp, Artificial Sequence
  Synthetic Oligonucleotide
uuugacuuuucaauggguguccuag

SEQ ID NO: 4252 - DNA, 25 bp, Artificial Sequence
  Synthetic Oligonucleotide
gaaaggcacugauguucugaaagct

SEQ ID NO: 4253 - DNA, 25 bp, Artificial Sequence
  Synthetic Oligonucleotide
cacagucuguaauuccccacuucaa

SEQ ID NO: 4254 - DNA, 25 bp, Artificial Sequence
  Synthetic Oligonucleotide
uuggcugauaauauugcagcauutt

SEQ ID NO: 4255 - DNA, 25 bp, Artificial Sequence
  Synthetic Oligonucleotide
gaaccuuuuagaaagaaauggactt

SEQ ID NO: 4256 - DNA, 25 bp, Artificial Sequence
  Synthetic Oligonucleotide
ccucgagauacuaaaggaagaautc

SEQ ID NO: 4257 - DNA, 25 bp, Artificial Sequence
  Synthetic Oligonucleotide
agauacuaaaggaagaauuccggtt

SEQ ID NO: 4258 - DNA, 25 bp, Artificial Sequence
  Synthetic Oligonucleotide
caucuaucagcugggaagauaucaa

SEQ ID NO: 4259 - DNA, 25 bp, Artificial Sequence
  Synthetic Oligonucleotide
cugaaacagaucugucgacuucugt

SEQ ID NO: 4260 - DNA, 25 bp, Artificial Sequence
  Synthetic Oligonucleotide
uuaguaaaauuggagguagcaaaca

SEQ ID NO: 4261 - DNA, 25 bp, Artificial Sequence
  Synthetic Oligonucleotide
agacacugugcagagggugaccaca

SEQ ID NO: 4262 - DNA, 25 bp, Artificial Sequence
  Synthetic Oligonucleotide
ccuuuaguaaaauuggagguagcaa

SEQ ID NO: 4263 - DNA, 25 bp, Artificial Sequence
  Synthetic Oligonucleotide
agcauuuuccagauggaagcuguat

SEQ ID NO: 4264 - DNA, 25 bp, Artificial Sequence
  Synthetic Oligonucleotide
cuguauaucuacaaggaccgagaag

SEQ ID NO: 4265 - DNA, 25 bp, Artificial Sequence
  Synthetic Oligonucleotide
uuuugacuuuucaauggguguccta

SEQ ID NO: 4266 - DNA, 25 bp, Artificial Sequence
  Synthetic Oligonucleotide
uaaagugcuguauccuuuaguaaaa

SEQ ID NO: 4267 - DNA, 25 bp, Artificial Sequence
  Synthetic Oligonucleotide
ccuaggaaccuuuuagaaagaaatg

SEQ ID NO: 4268 - DNA, 25 bp, Artificial Sequence
  Synthetic Oligonucleotide
agagacacugugcagagggugacca

SEQ ID NO: 4269 - DNA, 25 bp, Artificial Sequence
  Synthetic Oligonucleotide
ggguguccuaggaaccuuuuagaaa

SEQ ID NO: 4270 - DNA, 25 bp, Artificial Sequence
  Synthetic Oligonucleotide
acccaucuaucagcugggaagauat

SEQ ID NO: 4271 - DNA, 25 bp, Artificial Sequence
  Synthetic Oligonucleotide
uuucuccugaggaaaauuuuggaga

SEQ ID NO: 4272 - DNA, 25 bp, Artificial Sequence
  Synthetic Oligonucleotide
aagcaauagacccaucuaucagctg

SEQ ID NO: 4273 - DNA, 25 bp, Artificial Sequence
  Synthetic Oligonucleotide
ggggugccagccacuauugaugutc

SEQ ID NO: 4274 - DNA, 25 bp, Artificial Sequence
  Synthetic Oligonucleotide
gaaacagaucugucgacuucugutt

SEQ ID NO: 4275 - DNA, 25 bp, Artificial Sequence
  Synthetic Oligonucleotide
cccacuucaauacaaagggugucgt

SEQ ID NO: 4276 - DNA, 25 bp, Artificial Sequence
  Synthetic Oligonucleotide
uuacaugucuuuaaaacaguggutc

SEQ ID NO: 4277 - DNA, 25 bp, Artificial Sequence
  Synthetic Oligonucleotide
agaagguagcacuggagagaauugg

SEQ ID NO: 4278 - DNA, 25 bp, Artificial Sequence
  Synthetic Oligonucleotide
guauccaaggaugcuccggaaugtt

SEQ ID NO: 4279 - DNA, 25 bp, Artificial Sequence
  Synthetic Oligonucleotide
caaagggcauuuugagaggugauga

SEQ ID NO: 4280 - DNA, 25 bp, Artificial Sequence
  Synthetic Oligonucleotide
gguggcgguaauuggugauacuuct

SEQ ID NO: 4281 - DNA, 25 bp, Artificial Sequence
  Synthetic Oligonucleotide
caauuguugcaaagggcauuuugag

SEQ ID NO: 4282 - DNA, 25 bp, Artificial Sequence
  Synthetic Oligonucleotide
uguagauuuccaaucacaucuuuag

SEQ ID NO: 4283 - DNA, 25 bp, Artificial Sequence
  Synthetic Oligonucleotide
acaaagagacacugugcagagggtg

SEQ ID NO: 4284 - DNA, 25 bp, Artificial Sequence
  Synthetic Oligonucleotide
gcugaaacagaucugucgacuuctg

SEQ ID NO: 4285 - DNA, 25 bp, Artificial Sequence
  Synthetic Oligonucleotide
cugaggaaaauuuuggagacgacag

SEQ ID NO: 4286 - DNA, 25 bp, Artificial Sequence
  Synthetic Oligonucleotide
uagagagaaauaaagcauuuuuggg

SEQ ID NO: 4287 - DNA, 25 bp, Artificial Sequence
  Synthetic Oligonucleotide
gcuaaagcaauagacccaucuauca

SEQ ID NO: 4288 - DNA, 25 bp, Artificial Sequence
  Synthetic Oligonucleotide
cuaggaaccuuuuagaaagaaaugg

SEQ ID NO: 4289 - DNA, 25 bp, Artificial Sequence
  Synthetic Oligonucleotide
aucauugccaauuguugcaaagggc

SEQ ID NO: 4290 - DNA, 25 bp, Artificial Sequence
  Synthetic Oligonucleotide
agauggaagcuguauccaaggaugc

SEQ ID NO: 4291 - DNA, 25 bp, Artificial Sequence
  Synthetic Oligonucleotide
gugcagagggugaccacagucugta

SEQ ID NO: 4292 - DNA, 25 bp, Artificial Sequence
  Synthetic Oligonucleotide
auggaagcuguauccaaggaugctc

SEQ ID NO: 4293 - DNA, 25 bp, Artificial Sequence
  Synthetic Oligonucleotide
ucauugccaauuguugcaaagggca

SEQ ID NO: 4294 - DNA, 25 bp, Artificial Sequence
  Synthetic Oligonucleotide
agucaucgacaagacauuggugagg

SEQ ID NO: 4295 - DNA, 25 bp, Artificial Sequence
  Synthetic Oligonucleotide
guggcuaaagcaauagacccaucta

SEQ ID NO: 4296 - DNA, 25 bp, Artificial Sequence
  Synthetic Oligonucleotide
gucuggaugaugugcguaacagatt

SEQ ID NO: 4297 - DNA, 25 bp, Artificial Sequence
  Synthetic Oligonucleotide
cuccggaauguugcugaaacagatc

SEQ ID NO: 4298 - DNA, 25 bp, Artificial Sequence
  Synthetic Oligonucleotide
uuccaacaaaauagcaaucccuutt

SEQ ID NO: 4299 - DNA, 25 bp, Artificial Sequence
  Synthetic Oligonucleotide
uuuagaaagaaauggacuuucaucc

SEQ ID NO: 4300 - DNA, 25 bp, Artificial Sequence
  Synthetic Oligonucleotide
ggaaaggcacugauguucugaaagc

SEQ ID NO: 4301 - DNA, 25 bp, Artificial Sequence
  Synthetic Oligonucleotide
aagguguucaagauguccucgagat

SEQ ID NO: 4302 - DNA, 25 bp, Artificial Sequence
  Synthetic Oligonucleotide
gaaagguguucaagauguccucgag

SEQ ID NO: 4303 - DNA, 25 bp, Artificial Sequence
  Synthetic Oligonucleotide
uguugcaaagggcauuuugagaggt

SEQ ID NO: 4304 - DNA, 25 bp, Artificial Sequence
  Synthetic Oligonucleotide
uucuuuuccaacaaaauagcaaucc

SEQ ID NO: 4305 - DNA, 25 bp, Artificial Sequence
  Synthetic Oligonucleotide
acuucaauacaaagggugucguuct

SEQ ID NO: 4306 - DNA, 25 bp, Artificial Sequence
  Synthetic Oligonucleotide
uccaagaucugacagugcacaauat

SEQ ID NO: 4307 - DNA, 25 bp, Artificial Sequence
  Synthetic Oligonucleotide
cuucaauacaaagggugucguuctt

SEQ ID NO: 4308 - DNA, 25 bp, Artificial Sequence
  Synthetic Oligonucleotide
uuugagaagguagcacuggagagaa

SEQ ID NO: 4309 - DNA, 25 bp, Artificial Sequence
  Synthetic Oligonucleotide
gccgccacaacucaggaugaaaaat

SEQ ID NO: 4310 - DNA, 25 bp, Artificial Sequence
  Synthetic Oligonucleotide
ugcugaaacagaucugucgacuuct

SEQ ID NO: 4311 - DNA, 25 bp, Artificial Sequence
  Synthetic Oligonucleotide
aaccuuuuagaaagaaauggacutt

SEQ ID NO: 4312 - DNA, 25 bp, Artificial Sequence
  Synthetic Oligonucleotide
ugucuuuaaaacagugguucuuaaa

SEQ ID NO: 4313 - DNA, 25 bp, Artificial Sequence
  Synthetic Oligonucleotide
ugauguucugccagaaauuguggag

SEQ ID NO: 4314 - DNA, 25 bp, Artificial Sequence
  Synthetic Oligonucleotide
ggugccagccacuauugauguuctg

SEQ ID NO: 4315 - DNA, 25 bp, Artificial Sequence
  Synthetic Oligonucleotide
gacgacaguggacuugcugcauatg

SEQ ID NO: 4316 - DNA, 25 bp, Artificial Sequence
  Synthetic Oligonucleotide
uugcaaagggcauuuugagagguga

SEQ ID NO: 4317 - DNA, 25 bp, Artificial Sequence
  Synthetic Oligonucleotide
ggaccgagaagucaccaagaagcta

SEQ ID NO: 4318 - DNA, 25 bp, Artificial Sequence
  Synthetic Oligonucleotide
ccggaauguugcugaaacagauctg

SEQ ID NO: 4319 - DNA, 25 bp, Artificial Sequence
  Synthetic Oligonucleotide
ggucuggggcaaaugaugaagaaac

SEQ ID NO: 4320 - DNA, 25 bp, Artificial Sequence
  Synthetic Oligonucleotide
gccagccacuauugauguucugcca

SEQ ID NO: 4321 - DNA, 25 bp, Artificial Sequence
  Synthetic Oligonucleotide
gcggaaaggcacugauguucugaaa

SEQ ID NO: 4322 - DNA, 25 bp, Artificial Sequence
  Synthetic Oligonucleotide
ugcugcauauguggcuaaagcaata

SEQ ID NO: 4323 - DNA, 25 bp, Artificial Sequence
  Synthetic Oligonucleotide
gggaagauaucaaauggcugagaag

SEQ ID NO: 4324 - DNA, 25 bp, Artificial Sequence
  Synthetic Oligonucleotide
uguccuaggaaccuuuuagaaagaa

SEQ ID NO: 4325 - DNA, 25 bp, Artificial Sequence
  Synthetic Oligonucleotide
cgagauacuaaaggaagaauuccgg

SEQ ID NO: 4326 - DNA, 25 bp, Artificial Sequence
  Synthetic Oligonucleotide
ggcuacaaggccauauuugugacag

SEQ ID NO: 4327 - DNA, 25 bp, Artificial Sequence
  Synthetic Oligonucleotide
cacaacuuugagaagguagcacugg

SEQ ID NO: 4328 - DNA, 25 bp, Artificial Sequence
  Synthetic Oligonucleotide
acuucguuggcugcaacuguauatc

SEQ ID NO: 4329 - DNA, 25 bp, Artificial Sequence
  Synthetic Oligonucleotide
auguucugccagaaauuguggaggc

SEQ ID NO: 4330 - DNA, 25 bp, Artificial Sequence
  Synthetic Oligonucleotide
uagauuuccaaucacaucuuuagtg

SEQ ID NO: 4331 - DNA, 25 bp, Artificial Sequence
  Synthetic Oligonucleotide
gacuugcugcauauguggcuaaagc

SEQ ID NO: 4332 - DNA, 25 bp, Artificial Sequence
  Synthetic Oligonucleotide
cauuuuccagauggaagcuguaucc

SEQ ID NO: 4333 - DNA, 25 bp, Artificial Sequence
  Synthetic Oligonucleotide
acauuggugaggaaaaauccuuugg

SEQ ID NO: 4334 - DNA, 25 bp, Artificial Sequence
  Synthetic Oligonucleotide
ugccagccacuauugauguucugcc

SEQ ID NO: 4335 - DNA, 25 bp, Artificial Sequence
  Synthetic Oligonucleotide
caaggaccgagaagucaccaagaag

SEQ ID NO: 4336 - DNA, 25 bp, Artificial Sequence
  Synthetic Oligonucleotide
aggccauauuugugacaguggacac

SEQ ID NO: 4337 - DNA, 25 bp, Artificial Sequence
  Synthetic Oligonucleotide
uggcgguaauuggugauacuucutt

SEQ ID NO: 4338 - DNA, 25 bp, Artificial Sequence
  Synthetic Oligonucleotide
uauccaaggaugcuccggaaugutg

SEQ ID NO: 4339 - DNA, 25 bp, Artificial Sequence
  Synthetic Oligonucleotide
gauggaagcuguauccaaggaugct

SEQ ID NO: 4340 - DNA, 25 bp, Artificial Sequence
  Synthetic Oligonucleotide
aauggguguccuaggaaccuuuuag

SEQ ID NO: 4341 - DNA, 25 bp, Artificial Sequence
  Synthetic Oligonucleotide
aacuuugagaagguagcacuggaga

SEQ ID NO: 4342 - DNA, 25 bp, Artificial Sequence
  Synthetic Oligonucleotide
acaugucuuuaaaacagugguuctt

SEQ ID NO: 4343 - DNA, 25 bp, Artificial Sequence
  Synthetic Oligonucleotide
uggguggcgguaauuggugauactt

SEQ ID NO: 4344 - DNA, 25 bp, Artificial Sequence
  Synthetic Oligonucleotide
uucaauggguguccuaggaaccutt

SEQ ID NO: 4345 - DNA, 25 bp, Artificial Sequence
  Synthetic Oligonucleotide
ugacaaagagacacugugcagaggg

SEQ ID NO: 4346 - DNA, 25 bp, Artificial Sequence
  Synthetic Oligonucleotide
aaagaaauggacuuucauccuggaa

SEQ ID NO: 4347 - DNA, 25 bp, Artificial Sequence
  Synthetic Oligonucleotide
uguauccuuuaguaaaauuggaggt

SEQ ID NO: 4348 - DNA, 25 bp, Artificial Sequence
  Synthetic Oligonucleotide
aucagcugggaagauaucaaauggc

SEQ ID NO: 4349 - DNA, 25 bp, Artificial Sequence
  Synthetic Oligonucleotide
gugccagccacuauugauguucugc

SEQ ID NO: 4350 - DNA, 25 bp, Artificial Sequence
  Synthetic Oligonucleotide
caggucuggggcaaaugaugaagaa

SEQ ID NO: 4351 - DNA, 25 bp, Artificial Sequence
  Synthetic Oligonucleotide
gggugccagaaugugaaagucaucg

SEQ ID NO: 4352 - DNA, 25 bp, Artificial Sequence
  Synthetic Oligonucleotide
uggaagcuguauccaaggaugcucc

SEQ ID NO: 4353 - DNA, 25 bp, Artificial Sequence
  Synthetic Oligonucleotide
ugagugggugccagaaugugaaagt

SEQ ID NO: 4354 - DNA, 25 bp, Artificial Sequence
  Synthetic Oligonucleotide
uuuccagauggaagcuguauccaag

SEQ ID NO: 4355 - DNA, 25 bp, Artificial Sequence
  Synthetic Oligonucleotide
aucuacaaggaccgagaagucacca

SEQ ID NO: 4356 - DNA, 25 bp, Artificial Sequence
  Synthetic Oligonucleotide
aggaaaauuuuggagacgacagugg

SEQ ID NO: 4357 - DNA, 25 bp, Artificial Sequence
  Synthetic Oligonucleotide
gggugaccacagucuguaauucccc

SEQ ID NO: 4358 - DNA, 25 bp, Artificial Sequence
  Synthetic Oligonucleotide
gacaaagagacacugugcagagggt

SEQ ID NO: 4359 - DNA, 25 bp, Artificial Sequence
  Synthetic Oligonucleotide
agguguucaagauguccucgagata

SEQ ID NO: 4360 - DNA, 25 bp, Artificial Sequence
  Synthetic Oligonucleotide
gcacuggagagaauuggaaugggtg

SEQ ID NO: 4361 - DNA, 25 bp, Artificial Sequence
  Synthetic Oligonucleotide
uacaugucuuuaaaacagugguuct

SEQ ID NO: 4362 - DNA, 25 bp, Artificial Sequence
  Synthetic Oligonucleotide
gagaagucaccaagaagcuagugcg

SEQ ID NO: 4363 - DNA, 25 bp, Artificial Sequence
  Synthetic Oligonucleotide
ucuauauaugacuauuacagguctg

SEQ ID NO: 4364 - DNA, 25 bp, Artificial Sequence
  Synthetic Oligonucleotide
cuauauaugacuauuacaggucugg

SEQ ID NO: 4365 - DNA, 25 bp, Artificial Sequence
  Synthetic Oligonucleotide
aaagggcauuuugagaggugaugat

SEQ ID NO: 4366 - DNA, 25 bp, Artificial Sequence
  Synthetic Oligonucleotide
gaagauaucaaauggcugagaagac

SEQ ID NO: 4367 - DNA, 25 bp, Artificial Sequence
  Synthetic Oligonucleotide
agauucaaacugccgccacaacuca

SEQ ID NO: 4368 - DNA, 25 bp, Artificial Sequence
  Synthetic Oligonucleotide
gaugcuccggaauguugcugaaaca

SEQ ID NO: 4369 - DNA, 25 bp, Artificial Sequence
  Synthetic Oligonucleotide
ugaggaaaauuuuggagacgacagt

SEQ ID NO: 4370 - DNA, 25 bp, Artificial Sequence
  Synthetic Oligonucleotide
acaaggaccgagaagucaccaagaa

SEQ ID NO: 4371 - DNA, 25 bp, Artificial Sequence
  Synthetic Oligonucleotide
aaaugaugaagaaacuuuggcugat

SEQ ID NO: 4372 - DNA, 25 bp, Artificial Sequence
  Synthetic Oligonucleotide
aggcacugauguucugaaagcuctg

SEQ ID NO: 4373 - DNA, 25 bp, Artificial Sequence
  Synthetic Oligonucleotide
caaaugaugaagaaacuuuggcuga

SEQ ID NO: 4374 - DNA, 25 bp, Artificial Sequence
  Synthetic Oligonucleotide
ggguggcgguaauuggugauacutc

SEQ ID NO: 4375 - DNA, 25 bp, Artificial Sequence
  Synthetic Oligonucleotide
uggggcaaaugaugaagaaacuutg

SEQ ID NO: 4376 - DNA, 25 bp, Artificial Sequence
  Synthetic Oligonucleotide
auggguggcgguaauuggugauact

SEQ ID NO: 4377 - DNA, 25 bp, Artificial Sequence
  Synthetic Oligonucleotide
gucgacuucuguuuuaggacagagg

SEQ ID NO: 4378 - DNA, 25 bp, Artificial Sequence
  Synthetic Oligonucleotide
ugcaacuguauaucuacaaggaccg

SEQ ID NO: 4379 - DNA, 25 bp, Artificial Sequence
  Synthetic Oligonucleotide
auauguggcuaaagcaauagaccca

SEQ ID NO: 4380 - DNA, 25 bp, Artificial Sequence
  Synthetic Oligonucleotide
cugccgccacaacucaggaugaaaa

SEQ ID NO: 4381 - DNA, 25 bp, Artificial Sequence
  Synthetic Oligonucleotide
uaucagcugggaagauaucaaaugg

SEQ ID NO: 4382 - DNA, 25 bp, Artificial Sequence
  Synthetic Oligonucleotide
aaauuggagguagcaaacacuaagg

SEQ ID NO: 4383 - DNA, 25 bp, Artificial Sequence
  Synthetic Oligonucleotide
cauuggugaggaaaaauccuuuggc

SEQ ID NO: 4384 - DNA, 25 bp, Artificial Sequence
  Synthetic Oligonucleotide
aaagagacacugugcagagggugac

SEQ ID NO: 4385 - DNA, 25 bp, Artificial Sequence
  Synthetic Oligonucleotide
accacagucuguaauuccccacutc

SEQ ID NO: 4386 - DNA, 25 bp, Artificial Sequence
  Synthetic Oligonucleotide
gagaaagguguucaagauguccucg

SEQ ID NO: 4387 - DNA, 25 bp, Artificial Sequence
  Synthetic Oligonucleotide
uugagaagguagcacuggagagaat

SEQ ID NO: 4388 - DNA, 25 bp, Artificial Sequence
  Synthetic Oligonucleotide
agggcauuuugagaggugaugaugc

SEQ ID NO: 4389 - DNA, 25 bp, Artificial Sequence
  Synthetic Oligonucleotide
acaggucuggggcaaaugaugaaga

SEQ ID NO: 4390 - DNA, 25 bp, Artificial Sequence
  Synthetic Oligonucleotide
uuuucuccugaggaaaauuuuggag

SEQ ID NO: 4391 - DNA, 25 bp, Artificial Sequence
  Synthetic Oligonucleotide
auccuuuaguaaaauuggagguagc

SEQ ID NO: 4392 - DNA, 25 bp, Artificial Sequence
  Synthetic Oligonucleotide
cuaucagcugggaagauaucaaatg

SEQ ID NO: 4393 - DNA, 25 bp, Artificial Sequence
  Synthetic Oligonucleotide
gggccaccuccucaauugaagaagt

SEQ ID NO: 4394 - DNA, 25 bp, Artificial Sequence
  Synthetic Oligonucleotide
uacaaggaccgagaagucaccaaga

SEQ ID NO: 4395 - DNA, 25 bp, Artificial Sequence
  Synthetic Oligonucleotide
aauggguggcgguaauuggugauac

SEQ ID NO: 4396 - DNA, 25 bp, Artificial Sequence
  Synthetic Oligonucleotide
gcuacaaggccauauuugugacagt

SEQ ID NO: 4397 - DNA, 25 bp, Artificial Sequence
  Synthetic Oligonucleotide
uucuccugaggaaaauuuuggagac

SEQ ID NO: 4398 - DNA, 25 bp, Artificial Sequence
  Synthetic Oligonucleotide
gaccgagaagucaccaagaagcuag

SEQ ID NO: 4399 - DNA, 25 bp, Artificial Sequence
  Synthetic Oligonucleotide
guguccuaggaaccuuuuagaaaga

SEQ ID NO: 4400 - DNA, 25 bp, Artificial Sequence
  Synthetic Oligonucleotide
cgagaagucaccaagaagcuagugc

SEQ ID NO: 4401 - DNA, 25 bp, Artificial Sequence
  Synthetic Oligonucleotide
ucgagauacuaaaggaagaauuccg

SEQ ID NO: 4402 - DNA, 25 bp, Artificial Sequence
  Synthetic Oligonucleotide
agacgacaguggacuugcugcauat

SEQ ID NO: 4403 - DNA, 25 bp, Artificial Sequence
  Synthetic Oligonucleotide
gacccaucuaucagcugggaagata

SEQ ID NO: 4404 - DNA, 25 bp, Artificial Sequence
  Synthetic Oligonucleotide
cugagugggugccagaaugugaaag

SEQ ID NO: 4405 - DNA, 25 bp, Artificial Sequence
  Synthetic Oligonucleotide
caaagagacacugugcagaggguga

SEQ ID NO: 4406 - DNA, 25 bp, Artificial Sequence
  Synthetic Oligonucleotide
gcugcauauguggcuaaagcaauag

SEQ ID NO: 4407 - DNA, 25 bp, Artificial Sequence
  Synthetic Oligonucleotide
uucuuagagagaaauaaagcauutt

SEQ ID NO: 4408 - DNA, 25 bp, Artificial Sequence
  Synthetic Oligonucleotide
caauggguguccuaggaaccuuuta

SEQ ID NO: 4409 - DNA, 25 bp, Artificial Sequence
  Synthetic Oligonucleotide
ccaucuaucagcugggaagauauca

SEQ ID NO: 4410 - DNA, 25 bp, Artificial Sequence
  Synthetic Oligonucleotide
uauauaugacuauuacaggucuggg

SEQ ID NO: 4411 - DNA, 25 bp, Artificial Sequence
  Synthetic Oligonucleotide
aggucuggggcaaaugaugaagaaa

SEQ ID NO: 4412 - DNA, 25 bp, Artificial Sequence
  Synthetic Oligonucleotide
auagacccaucuaucagcugggaag

SEQ ID NO: 4413 - DNA, 25 bp, Artificial Sequence
  Synthetic Oligonucleotide
ugccaauuguugcaaagggcauutt

SEQ ID NO: 4414 - DNA, 25 bp, Artificial Sequence
  Synthetic Oligonucleotide
auguccucgagauacuaaaggaaga

SEQ ID NO: 4415 - DNA, 25 bp, Artificial Sequence
  Synthetic Oligonucleotide
guugcaaagggcauuuugagaggtg

SEQ ID NO: 4416 - DNA, 25 bp, Artificial Sequence
  Synthetic Oligonucleotide
gugcggaaaggcacugauguucuga

SEQ ID NO: 4417 - DNA, 25 bp, Artificial Sequence
  Synthetic Oligonucleotide
uccggaauguugcugaaacagauct

SEQ ID NO: 4418 - DNA, 25 bp, Artificial Sequence
  Synthetic Oligonucleotide
guagcacuggagagaauuggaaugg

SEQ ID NO: 4419 - DNA, 25 bp, Artificial Sequence
  Synthetic Oligonucleotide
acaguggacuugcugcauauguggc

SEQ ID NO: 4420 - DNA, 25 bp, Artificial Sequence
  Synthetic Oligonucleotide
aguggacuugcugcauauguggcta

SEQ ID NO: 4421 - DNA, 25 bp, Artificial Sequence
  Synthetic Oligonucleotide
aggcacuucguuggcugcaacugta

SEQ ID NO: 4422 - DNA, 25 bp, Artificial Sequence
  Synthetic Oligonucleotide
uuccaaucacaucuuuagugucuga

SEQ ID NO: 4423 - DNA, 25 bp, Artificial Sequence
  Synthetic Oligonucleotide
uuuuggagacgacaguggacuugct

SEQ ID NO: 4424 - DNA, 25 bp, Artificial Sequence
  Synthetic Oligonucleotide
uccuuuaguaaaauuggagguagca

SEQ ID NO: 4425 - DNA, 25 bp, Artificial Sequence
  Synthetic Oligonucleotide
ugaaugggaucuuggugucgaauca

SEQ ID NO: 4426 - DNA, 25 bp, Artificial Sequence
  Synthetic Oligonucleotide
acugauguucugaaagcucuggctc

SEQ ID NO: 4427 - DNA, 25 bp, Artificial Sequence
  Synthetic Oligonucleotide
cuugccacugugagagccugucagt

SEQ ID NO: 4428 - DNA, 25 bp, Artificial Sequence
  Synthetic Oligonucleotide
aaaauuuuggagacgacaguggact

SEQ ID NO: 4429 - DNA, 25 bp, Artificial Sequence
  Synthetic Oligonucleotide
gugaccacagucuguaauuccccac

SEQ ID NO: 4430 - DNA, 25 bp, Artificial Sequence
  Synthetic Oligonucleotide
ggacagagggucagcaugccaauat

SEQ ID NO: 4431 - DNA, 25 bp, Artificial Sequence
  Synthetic Oligonucleotide
guggcgguaauuggugauacuuctt

SEQ ID NO: 4432 - DNA, 25 bp, Artificial Sequence
  Synthetic Oligonucleotide
gcauuuugagaggugaugaugccag

SEQ ID NO: 4433 - DNA, 25 bp, Artificial Sequence
  Synthetic Oligonucleotide
ggaagcuguauccaaggaugcuccg

SEQ ID NO: 4434 - DNA, 25 bp, Artificial Sequence
  Synthetic Oligonucleotide
uagcacuggagagaauuggaauggg

SEQ ID NO: 4435 - DNA, 25 bp, Artificial Sequence
  Synthetic Oligonucleotide
accgagaagucaccaagaagcuagt

SEQ ID NO: 4436 - DNA, 25 bp, Artificial Sequence
  Synthetic Oligonucleotide
cccaucuaucagcugggaagauatc

SEQ ID NO: 4437 - DNA, 25 bp, Artificial Sequence
  Synthetic Oligonucleotide
ggaggcuguuaaacauggcuugaat

SEQ ID NO: 4438 - DNA, 25 bp, Artificial Sequence
  Synthetic Oligonucleotide
aggaccgagaagucaccaagaagct

SEQ ID NO: 4439 - DNA, 25 bp, Artificial Sequence
  Synthetic Oligonucleotide
ugggaagauaucaaauggcugagaa

SEQ ID NO: 4440 - DNA, 25 bp, Artificial Sequence
  Synthetic Oligonucleotide
ucagcugggaagauaucaaauggct

SEQ ID NO: 4441 - DNA, 25 bp, Artificial Sequence
  Synthetic Oligonucleotide
uaaacauggcuugaaugggaucutg

SEQ ID NO: 4442 - DNA, 25 bp, Artificial Sequence
  Synthetic Oligonucleotide
gaaaauuuuggagacgacaguggac

SEQ ID NO: 4443 - DNA, 25 bp, Artificial Sequence
  Synthetic Oligonucleotide
ggagaaagguguucaagaugucctc

SEQ ID NO: 4444 - DNA, 25 bp, Artificial Sequence
  Synthetic Oligonucleotide
ugcaaagggcauuuugagaggugat

SEQ ID NO: 4445 - DNA, 25 bp, Artificial Sequence
  Synthetic Oligonucleotide
uuguugcaaagggcauuuugagagg

SEQ ID NO: 4446 - DNA, 25 bp, Artificial Sequence
  Synthetic Oligonucleotide
uuuccaacaaaauagcaaucccutt

SEQ ID NO: 4447 - DNA, 25 bp, Artificial Sequence
  Synthetic Oligonucleotide
uuccccacuucaauacaaagggugt

SEQ ID NO: 4448 - DNA, 25 bp, Artificial Sequence
  Synthetic Oligonucleotide
acuauuacaggucuggggcaaauga

SEQ ID NO: 4449 - DNA, 25 bp, Artificial Sequence
  Synthetic Oligonucleotide
aaauuguggaggcuguggaagggaa

SEQ ID NO: 4450 - DNA, 25 bp, Artificial Sequence
  Synthetic Oligonucleotide
ugcagagggugaccacagucuguaa

SEQ ID NO: 4451 - DNA, 25 bp, Artificial Sequence
  Synthetic Oligonucleotide
cauugccaauuguugcaaagggcat

SEQ ID NO: 4452 - DNA, 25 bp, Artificial Sequence
  Synthetic Oligonucleotide
auccaaggaugcuccggaauguugc

SEQ ID NO: 4453 - DNA, 25 bp, Artificial Sequence
  Synthetic Oligonucleotide
gauacuaaaggaagaauuccggutg

SEQ ID NO: 4454 - DNA, 25 bp, Artificial Sequence
  Synthetic Oligonucleotide
gagacacugugcagagggugaccac

SEQ ID NO: 4455 - DNA, 25 bp, Artificial Sequence
  Synthetic Oligonucleotide
aaauuuuggagacgacaguggactt

SEQ ID NO: 4456 - DNA, 25 bp, Artificial Sequence
  Synthetic Oligonucleotide
ucugucgacuucuguuuuaggacag

SEQ ID NO: 4457 - DNA, 25 bp, Artificial Sequence
  Synthetic Oligonucleotide
ugaccacagucuguaauuccccact

SEQ ID NO: 4458 - DNA, 25 bp, Artificial Sequence
  Synthetic Oligonucleotide
cugugcagagggugaccacaguctg

SEQ ID NO: 4459 - DNA, 25 bp, Artificial Sequence
  Synthetic Oligonucleotide
ucaauggguguccuaggaaccuutt

SEQ ID NO: 4460 - DNA, 25 bp, Artificial Sequence
  Synthetic Oligonucleotide
uuucaauggguguccuaggaacctt

SEQ ID NO: 4461 - DNA, 25 bp, Artificial Sequence
  Synthetic Oligonucleotide
gugugcggaaaggcacugauguuct

SEQ ID NO: 4462 - DNA, 25 bp, Artificial Sequence
  Synthetic Oligonucleotide
uguggcuaaagcaauagacccauct

SEQ ID NO: 4463 - DNA, 25 bp, Artificial Sequence
  Synthetic Oligonucleotide
gacuucuguuuuaggacagagggtc

SEQ ID NO: 4464 - DNA, 25 bp, Artificial Sequence
  Synthetic Oligonucleotide
auuuccaaucacaucuuuaguguct

SEQ ID NO: 4465 - DNA, 25 bp, Artificial Sequence
  Synthetic Oligonucleotide
uguccucgagauacuaaaggaagaa

SEQ ID NO: 4466 - DNA, 25 bp, Artificial Sequence
  Synthetic Oligonucleotide
gcaaagggcauuuugagaggugatg

SEQ ID NO: 4467 - DNA, 25 bp, Artificial Sequence
  Synthetic Oligonucleotide
auacuaaaggaagaauuccgguugg

SEQ ID NO: 4468 - DNA, 25 bp, Artificial Sequence
  Synthetic Oligonucleotide
cuugaaugggaucuuggugucgaat

SEQ ID NO: 4469 - DNA, 25 bp, Artificial Sequence
  Synthetic Oligonucleotide
uguuuuaggacagagggucagcatg

SEQ ID NO: 4470 - DNA, 25 bp, Artificial Sequence
  Synthetic Oligonucleotide
gggaacgggcaugauguugaguucc

SEQ ID NO: 4471 - DNA, 25 bp, Artificial Sequence
  Synthetic Oligonucleotide
ucuacaaggaccgagaagucaccaa

SEQ ID NO: 4472 - DNA, 25 bp, Artificial Sequence
  Synthetic Oligonucleotide
uccugaggaaaauuuuggagacgac

SEQ ID NO: 4473 - DNA, 25 bp, Artificial Sequence
  Synthetic Oligonucleotide
gcuguuaaacauggcuugaauggga

SEQ ID NO: 4474 - DNA, 25 bp, Artificial Sequence
  Synthetic Oligonucleotide
auggggugccagccacuauugaugt

SEQ ID NO: 4475 - DNA, 25 bp, Artificial Sequence
  Synthetic Oligonucleotide
augggcuacaaggccauauuuguga

SEQ ID NO: 4476 - DNA, 25 bp, Artificial Sequence
  Synthetic Oligonucleotide
cuguuaaacauggcuugaaugggat

SEQ ID NO: 4477 - DNA, 25 bp, Artificial Sequence
  Synthetic Oligonucleotide
ggcauuuugagaggugaugaugcca

SEQ ID NO: 4478 - DNA, 25 bp, Artificial Sequence
  Synthetic Oligonucleotide
aauuuuggagacgacaguggacutg

SEQ ID NO: 4479 - DNA, 25 bp, Artificial Sequence
  Synthetic Oligonucleotide
ugggugccagaaugugaaagucatc

SEQ ID NO: 4480 - DNA, 25 bp, Artificial Sequence
  Synthetic Oligonucleotide
aaccgucuggaugaugugcguaaca

SEQ ID NO: 4481 - DNA, 25 bp, Artificial Sequence
  Synthetic Oligonucleotide
gcaauagacccaucuaucagcuggg

SEQ ID NO: 4482 - DNA, 25 bp, Artificial Sequence
  Synthetic Oligonucleotide
uggacuugcugcauauguggcuaaa

SEQ ID NO: 4483 - DNA, 25 bp, Artificial Sequence
  Synthetic Oligonucleotide
auugccaauuguugcaaagggcatt

SEQ ID NO: 4484 - DNA, 25 bp, Artificial Sequence
  Synthetic Oligonucleotide
cuauuacaggucuggggcaaaugat

SEQ ID NO: 4485 - DNA, 25 bp, Artificial Sequence
  Synthetic Oligonucleotide
ccaaggaugcuccggaauguugctg

SEQ ID NO: 4486 - DNA, 25 bp, Artificial Sequence
  Synthetic Oligonucleotide
ccagaaauuguggaggcuguggaag

SEQ ID NO: 4487 - DNA, 25 bp, Artificial Sequence
  Synthetic Oligonucleotide
uacaaggccauauuugugacagugg

SEQ ID NO: 4488 - DNA, 25 bp, Artificial Sequence
  Synthetic Oligonucleotide
gaauggguggcgguaauuggugata

SEQ ID NO: 4489 - DNA, 25 bp, Artificial Sequence
  Synthetic Oligonucleotide
cgauggggugccagccacuauugat

SEQ ID NO: 4490 - DNA, 25 bp, Artificial Sequence
  Synthetic Oligonucleotide
aaacauggcuugaaugggaucuugg

SEQ ID NO: 4491 - DNA, 25 bp, Artificial Sequence
  Synthetic Oligonucleotide
ccccacuucaauacaaagggugucg

SEQ ID NO: 4492 - DNA, 25 bp, Artificial Sequence
  Synthetic Oligonucleotide
uguuuacaugucuuuaaaacagugg

SEQ ID NO: 4493 - DNA, 25 bp, Artificial Sequence
  Synthetic Oligonucleotide
cugauguucugaaagcucuggcuct

SEQ ID NO: 4494 - DNA, 25 bp, Artificial Sequence
  Synthetic Oligonucleotide
ucugagugggugccagaaugugaaa

SEQ ID NO: 4495 - DNA, 25 bp, Artificial Sequence
  Synthetic Oligonucleotide
uugacaaagagacacugugcagagg

SEQ ID NO: 4496 - DNA, 25 bp, Artificial Sequence
  Synthetic Oligonucleotide
ucgacuucuguuuuaggacagaggg

SEQ ID NO: 4497 - DNA, 25 bp, Artificial Sequence
  Synthetic Oligonucleotide
ggagacgacaguggacuugcugcat

SEQ ID NO: 4498 - DNA, 25 bp, Artificial Sequence
  Synthetic Oligonucleotide
gggcauuuugagaggugaugaugcc

SEQ ID NO: 4499 - DNA, 25 bp, Artificial Sequence
  Synthetic Oligonucleotide
caacuuugagaagguagcacuggag

SEQ ID NO: 4500 - DNA, 25 bp, Artificial Sequence
  Synthetic Oligonucleotide
gggcuacaaggccauauuugugaca

SEQ ID NO: 4501 - DNA, 25 bp, Artificial Sequence
  Synthetic Oligonucleotide
ggccaccuccucaauugaagaagtg

SEQ ID NO: 4502 - DNA, 25 bp, Artificial Sequence
  Synthetic Oligonucleotide
guuuccaagaucugacagugcacaa

SEQ ID NO: 4503 - DNA, 25 bp, Artificial Sequence
  Synthetic Oligonucleotide
ggcaaaugaugaagaaacuuuggct

SEQ ID NO: 4504 - DNA, 25 bp, Artificial Sequence
  Synthetic Oligonucleotide
augggaucuuggugucgaaucaugg

SEQ ID NO: 4505 - DNA, 25 bp, Artificial Sequence
  Synthetic Oligonucleotide
cguaacagauucaaacugccgccac

SEQ ID NO: 4506 - DNA, 25 bp, Artificial Sequence
  Synthetic Oligonucleotide
ugggcuacaaggccauauuugugac

SEQ ID NO: 4507 - DNA, 25 bp, Artificial Sequence
  Synthetic Oligonucleotide
ggaacgggcaugauguugaguucct

SEQ ID NO: 4508 - DNA, 25 bp, Artificial Sequence
  Synthetic Oligonucleotide
cuguuuuaggacagagggucagcat

SEQ ID NO: 4509 - DNA, 25 bp, Artificial Sequence
  Synthetic Oligonucleotide
acugccgccacaacucaggaugaaa

SEQ ID NO: 4510 - DNA, 25 bp, Artificial Sequence
  Synthetic Oligonucleotide
gaagaugggcuacaaggccauautt

SEQ ID NO: 4511 - DNA, 25 bp, Artificial Sequence
  Synthetic Oligonucleotide
acagauucaaacugccgccacaact

SEQ ID NO: 4512 - DNA, 25 bp, Artificial Sequence
  Synthetic Oligonucleotide
uccaaggaugcuccggaauguugct

SEQ ID NO: 4513 - DNA, 25 bp, Artificial Sequence
  Synthetic Oligonucleotide
uccagauggaagcuguauccaagga

SEQ ID NO: 4514 - DNA, 25 bp, Artificial Sequence
  Synthetic Oligonucleotide
agcuguauccaaggaugcuccggaa

SEQ ID NO: 4515 - DNA, 25 bp, Artificial Sequence
  Synthetic Oligonucleotide
gauggggugccagccacuauugatg

SEQ ID NO: 4516 - DNA, 25 bp, Artificial Sequence
  Synthetic Oligonucleotide
uuggagacgacaguggacuugcugc

SEQ ID NO: 4517 - DNA, 25 bp, Artificial Sequence
  Synthetic Oligonucleotide
uuaaacauggcuugaaugggauctt

SEQ ID NO: 4518 - DNA, 25 bp, Artificial Sequence
  Synthetic Oligonucleotide
gcacuucguuggcugcaacuguata

SEQ ID NO: 4519 - DNA, 25 bp, Artificial Sequence
  Synthetic Oligonucleotide
ggcuugaaugggaucuuggugucga

SEQ ID NO: 4520 - DNA, 25 bp, Artificial Sequence
  Synthetic Oligonucleotide
agcugggaagauaucaaauggcuga

SEQ ID NO: 4521 - DNA, 25 bp, Artificial Sequence
  Synthetic Oligonucleotide
uuccagauggaagcuguauccaagg

SEQ ID NO: 4522 - DNA, 25 bp, Artificial Sequence
  Synthetic Oligonucleotide
caauagacccaucuaucagcuggga

SEQ ID NO: 4523 - DNA, 25 bp, Artificial Sequence
  Synthetic Oligonucleotide
uuuccaagaucugacagugcacaat

SEQ ID NO: 4524 - DNA, 25 bp, Artificial Sequence
  Synthetic Oligonucleotide
acuuugagaagguagcacuggagag

SEQ ID NO: 4525 - DNA, 25 bp, Artificial Sequence
  Synthetic Oligonucleotide
gccacugugagagccugucaguccc

SEQ ID NO: 4526 - DNA, 25 bp, Artificial Sequence
  Synthetic Oligonucleotide
cauggcuugaaugggaucuuggugt

SEQ ID NO: 4527 - DNA, 25 bp, Artificial Sequence
  Synthetic Oligonucleotide
cugggaagauaucaaauggcugaga

SEQ ID NO: 4528 - DNA, 25 bp, Artificial Sequence
  Synthetic Oligonucleotide
uugaaugggaucuuggugucgaatc

SEQ ID NO: 4529 - DNA, 25 bp, Artificial Sequence
  Synthetic Oligonucleotide
aauagacccaucuaucagcugggaa

SEQ ID NO: 4530 - DNA, 25 bp, Artificial Sequence
  Synthetic Oligonucleotide
uugacuuuucaauggguguccuagg

SEQ ID NO: 4531 - DNA, 25 bp, Artificial Sequence
  Synthetic Oligonucleotide
cuaaaggaagaauuccgguuggcca

SEQ ID NO: 4532 - DNA, 25 bp, Artificial Sequence
  Synthetic Oligonucleotide
ugccgccacaacucaggaugaaaaa

SEQ ID NO: 4533 - DNA, 25 bp, Artificial Sequence
  Synthetic Oligonucleotide
ugugcguaacagauucaaacugccg

SEQ ID NO: 4534 - DNA, 25 bp, Artificial Sequence
  Synthetic Oligonucleotide
gcaaaugaugaagaaacuuuggctg

SEQ ID NO: 4535 - DNA, 25 bp, Artificial Sequence
  Synthetic Oligonucleotide
aacgggcaugauguugaguuccugg

SEQ ID NO: 4536 - DNA, 25 bp, Artificial Sequence
  Synthetic Oligonucleotide
gcuugaaugggaucuuggugucgaa

SEQ ID NO: 4537 - DNA, 25 bp, Artificial Sequence
  Synthetic Oligonucleotide
auuggugaggaaaaauccuuuggcc

SEQ ID NO: 4538 - DNA, 25 bp, Artificial Sequence
  Synthetic Oligonucleotide
cgaaucauggggcucgacaacucga

SEQ ID NO: 4539 - DNA, 25 bp, Artificial Sequence
  Synthetic Oligonucleotide
agaugggcuacaaggccauauuugt

SEQ ID NO: 4540 - DNA, 25 bp, Artificial Sequence
  Synthetic Oligonucleotide
gugcguaacagauucaaacugccgc

SEQ ID NO: 4541 - DNA, 25 bp, Artificial Sequence
  Synthetic Oligonucleotide
cuuugagaagguagcacuggagaga

SEQ ID NO: 4542 - DNA, 25 bp, Artificial Sequence
  Synthetic Oligonucleotide
auuacaggucuggggcaaaugauga

SEQ ID NO: 4543 - DNA, 25 bp, Artificial Sequence
  Synthetic Oligonucleotide
ugacuuuucaauggguguccuagga

SEQ ID NO: 4544 - DNA, 25 bp, Artificial Sequence
  Synthetic Oligonucleotide
cacugugcagagggugaccacagtc

SEQ ID NO: 4545 - DNA, 25 bp, Artificial Sequence
  Synthetic Oligonucleotide
gaaauuguggaggcuguggaaggga

SEQ ID NO: 4546 - DNA, 25 bp, Artificial Sequence
  Synthetic Oligonucleotide
uugccaauuguugcaaagggcautt

SEQ ID NO: 4547 - DNA, 25 bp, Artificial Sequence
  Synthetic Oligonucleotide
cuguggaagggaagguggaaguctt

SEQ ID NO: 4548 - DNA, 25 bp, Artificial Sequence
  Synthetic Oligonucleotide
gcuugccacugugagagccugucag

SEQ ID NO: 4549 - DNA, 25 bp, Artificial Sequence
  Synthetic Oligonucleotide
guuuuaggacagagggucagcaugc

SEQ ID NO: 4550 - DNA, 25 bp, Artificial Sequence
  Synthetic Oligonucleotide
gaagggaagguggaagucuuccugg

SEQ ID NO: 4551 - DNA, 25 bp, Artificial Sequence
  Synthetic Oligonucleotide
gggcaaaugaugaagaaacuuuggc

SEQ ID NO: 4552 - DNA, 25 bp, Artificial Sequence
  Synthetic Oligonucleotide
aacugccgccacaacucaggaugaa

SEQ ID NO: 4553 - DNA, 25 bp, Artificial Sequence
  Synthetic Oligonucleotide
aagcuguauccaaggaugcuccgga

SEQ ID NO: 4554 - DNA, 25 bp, Artificial Sequence
  Synthetic Oligonucleotide
uuaggacagagggucagcaugccaa

SEQ ID NO: 4555 - DNA, 25 bp, Artificial Sequence
  Synthetic Oligonucleotide
ggacuugcugcauauguggcuaaag

SEQ ID NO: 4556 - DNA, 25 bp, Artificial Sequence
  Synthetic Oligonucleotide
cucugagugggugccagaaugugaa

SEQ ID NO: 4557 - DNA, 25 bp, Artificial Sequence
  Synthetic Oligonucleotide
auauaugacuauuacaggucugggg

SEQ ID NO: 4558 - DNA, 25 bp, Artificial Sequence
  Synthetic Oligonucleotide
uaacagauucaaacugccgccacaa

SEQ ID NO: 4559 - DNA, 25 bp, Artificial Sequence
  Synthetic Oligonucleotide
uuuccaaucacaucuuuaguguctg

SEQ ID NO: 4560 - DNA, 25 bp, Artificial Sequence
  Synthetic Oligonucleotide
aagagacacugugcagagggugacc

SEQ ID NO: 4561 - DNA, 25 bp, Artificial Sequence
  Synthetic Oligonucleotide
guggaagggaagguggaagucuucc

SEQ ID NO: 4562 - DNA, 25 bp, Artificial Sequence
  Synthetic Oligonucleotide
ccgagaagucaccaagaagcuagtg

SEQ ID NO: 4563 - DNA, 25 bp, Artificial Sequence
  Synthetic Oligonucleotide
ggcaaccgucuggaugaugugcgta

SEQ ID NO: 4564 - DNA, 25 bp, Artificial Sequence
  Synthetic Oligonucleotide
gcaggcuaaagugcuguauccuuta

SEQ ID NO: 4565 - DNA, 25 bp, Artificial Sequence
  Synthetic Oligonucleotide
gaggcuguuaaacauggcuugaatg

SEQ ID NO: 4566 - DNA, 25 bp, Artificial Sequence
  Synthetic Oligonucleotide
agaauuggaauggguggcgguaatt

SEQ ID NO: 4567 - DNA, 25 bp, Artificial Sequence
  Synthetic Oligonucleotide
cuuuucaauggguguccuaggaacc

SEQ ID NO: 4568 - DNA, 25 bp, Artificial Sequence
  Synthetic Oligonucleotide
gaugccagggaggcuguuaaacatg

SEQ ID NO: 4569 - DNA, 25 bp, Artificial Sequence
  Synthetic Oligonucleotide
gauucaaacugccgccacaacucag

SEQ ID NO: 4570 - DNA, 25 bp, Artificial Sequence
  Synthetic Oligonucleotide
aggacagagggucagcaugccaata

SEQ ID NO: 4571 - DNA, 25 bp, Artificial Sequence
  Synthetic Oligonucleotide
gacacugugcagagggugaccacag

SEQ ID NO: 4572 - DNA, 25 bp, Artificial Sequence
  Synthetic Oligonucleotide
ggugucgaaucauggggcucgacaa

SEQ ID NO: 4573 - DNA, 25 bp, Artificial Sequence
  Synthetic Oligonucleotide
uagacccaucuaucagcugggaaga

SEQ ID NO: 4574 - DNA, 25 bp, Artificial Sequence
  Synthetic Oligonucleotide
auggcuugaaugggaucuuggugtc

SEQ ID NO: 4575 - DNA, 25 bp, Artificial Sequence
  Synthetic Oligonucleotide
caaacugccgccacaacucaggatg

SEQ ID NO: 4576 - DNA, 25 bp, Artificial Sequence
  Synthetic Oligonucleotide
augaugccagggaggcuguuaaaca

SEQ ID NO: 4577 - DNA, 25 bp, Artificial Sequence
  Synthetic Oligonucleotide
cugggccaccuccucaauugaagaa

SEQ ID NO: 4578 - DNA, 25 bp, Artificial Sequence
  Synthetic Oligonucleotide
auguucugaaagcucuggcucuugg

SEQ ID NO: 4579 - DNA, 25 bp, Artificial Sequence
  Synthetic Oligonucleotide
uauuacaggucuggggcaaaugatg

SEQ ID NO: 4580 - DNA, 25 bp, Artificial Sequence
  Synthetic Oligonucleotide
uggggugccagccacuauugaugtt

SEQ ID NO: 4581 - DNA, 25 bp, Artificial Sequence
  Synthetic Oligonucleotide
cgacuucuguuuuaggacagagggt

SEQ ID NO: 4582 - DNA, 25 bp, Artificial Sequence
  Synthetic Oligonucleotide
acacugugcagagggugaccacagt

SEQ ID NO: 4583 - DNA, 25 bp, Artificial Sequence
  Synthetic Oligonucleotide
uaggacagagggucagcaugccaat

SEQ ID NO: 4584 - DNA, 25 bp, Artificial Sequence
  Synthetic Oligonucleotide
ggaagggaagguggaagucuucctg

SEQ ID NO: 4585 - DNA, 25 bp, Artificial Sequence
  Synthetic Oligonucleotide
ggcacugauguucugaaagcucugg

SEQ ID NO: 4586 - DNA, 25 bp, Artificial Sequence
  Synthetic Oligonucleotide
uacaggucuggggcaaaugaugaag

SEQ ID NO: 4587 - DNA, 25 bp, Artificial Sequence
  Synthetic Oligonucleotide
gaauuggaauggguggcgguaautg

SEQ ID NO: 4588 - DNA, 25 bp, Artificial Sequence
  Synthetic Oligonucleotide
uaucuacaaggaccgagaagucacc

SEQ ID NO: 4589 - DNA, 25 bp, Artificial Sequence
  Synthetic Oligonucleotide
cagauucaaacugccgccacaactc

SEQ ID NO: 4590 - DNA, 25 bp, Artificial Sequence
  Synthetic Oligonucleotide
gucuggggcaaaugaugaagaaact

SEQ ID NO: 4591 - DNA, 25 bp, Artificial Sequence
  Synthetic Oligonucleotide
gcaaccgucuggaugaugugcguaa

SEQ ID NO: 4592 - DNA, 25 bp, Artificial Sequence
  Synthetic Oligonucleotide
uuacaggucuggggcaaaugaugaa

SEQ ID NO: 4593 - DNA, 25 bp, Artificial Sequence
  Synthetic Oligonucleotide
ggggcaaaugaugaagaaacuuugg

SEQ ID NO: 4594 - DNA, 25 bp, Artificial Sequence
  Synthetic Oligonucleotide
aagaugggcuacaaggccauauutg

SEQ ID NO: 4595 - DNA, 25 bp, Artificial Sequence
  Synthetic Oligonucleotide
uggagacgacaguggacuugcugca

SEQ ID NO: 4596 - DNA, 25 bp, Artificial Sequence
  Synthetic Oligonucleotide
uuuugagaggugaugaugccaggga

SEQ ID NO: 4597 - DNA, 25 bp, Artificial Sequence
  Synthetic Oligonucleotide
agaagucaccaagaagcuagugcgg

SEQ ID NO: 4598 - DNA, 25 bp, Artificial Sequence
  Synthetic Oligonucleotide
gaacgggcaugauguugaguucctg

SEQ ID NO: 4599 - DNA, 25 bp, Artificial Sequence
  Synthetic Oligonucleotide
auuggaauggguggcgguaauuggt

SEQ ID NO: 4600 - DNA, 25 bp, Artificial Sequence
  Synthetic Oligonucleotide
guucugccagaaauuguggaggctg

SEQ ID NO: 4601 - DNA, 25 bp, Artificial Sequence
  Synthetic Oligonucleotide
gcuguggaagggaagguggaaguct

SEQ ID NO: 4602 - DNA, 25 bp, Artificial Sequence
  Synthetic Oligonucleotide
gaccaaucguuuggggcuuagcutt

SEQ ID NO: 4603 - DNA, 25 bp, Artificial Sequence
  Synthetic Oligonucleotide
aaacugccgccacaacucaggauga

SEQ ID NO: 4604 - DNA, 25 bp, Artificial Sequence
  Synthetic Oligonucleotide
ucuggggcaaaugaugaagaaactt

SEQ ID NO: 4605 - DNA, 25 bp, Artificial Sequence
  Synthetic Oligonucleotide
caauugaagaaguggcggaagcugg

SEQ ID NO: 4606 - DNA, 25 bp, Artificial Sequence
  Synthetic Oligonucleotide
aggcuaaagugcuguauccuuuagt

SEQ ID NO: 4607 - DNA, 25 bp, Artificial Sequence
  Synthetic Oligonucleotide
gcugggaagauaucaaauggcugag

SEQ ID NO: 4608 - DNA, 25 bp, Artificial Sequence
  Synthetic Oligonucleotide
gcuguauccaaggaugcuccggaat

SEQ ID NO: 4609 - DNA, 25 bp, Artificial Sequence
  Synthetic Oligonucleotide
agcuugccacugugagagccuguca

SEQ ID NO: 4610 - DNA, 25 bp, Artificial Sequence
  Synthetic Oligonucleotide
cugggaacgggcaugauguugagtt

SEQ ID NO: 4611 - DNA, 25 bp, Artificial Sequence
  Synthetic Oligonucleotide
ggaauggguggcgguaauuggugat

SEQ ID NO: 4612 - DNA, 25 bp, Artificial Sequence
  Synthetic Oligonucleotide
gugaugaugccagggaggcuguuaa

SEQ ID NO: 4613 - DNA, 25 bp, Artificial Sequence
  Synthetic Oligonucleotide
guuuagacaacgucauccccuggca

SEQ ID NO: 4614 - DNA, 25 bp, Artificial Sequence
  Synthetic Oligonucleotide
uuuggagacgacaguggacuugctg

SEQ ID NO: 4615 - DNA, 25 bp, Artificial Sequence
  Synthetic Oligonucleotide
cauuuugagaggugaugaugccagg

SEQ ID NO: 4616 - DNA, 25 bp, Artificial Sequence
  Synthetic Oligonucleotide
gaugggcuacaaggccauauuugtg

SEQ ID NO: 4617 - DNA, 25 bp, Artificial Sequence
  Synthetic Oligonucleotide
uacuaaaggaagaauuccgguuggc

SEQ ID NO: 4618 - DNA, 25 bp, Artificial Sequence
  Synthetic Oligonucleotide
uuugagaggugaugaugccagggag

SEQ ID NO: 4619 - DNA, 25 bp, Artificial Sequence
  Synthetic Oligonucleotide
gcacugauguucugaaagcucuggc

SEQ ID NO: 4620 - DNA, 25 bp, Artificial Sequence
  Synthetic Oligonucleotide
gggaggcuguuaaacauggcuugaa

SEQ ID NO: 4621 - DNA, 25 bp, Artificial Sequence
  Synthetic Oligonucleotide
ucuguuuuaggacagagggucagca

SEQ ID NO: 4622 - DNA, 25 bp, Artificial Sequence
  Synthetic Oligonucleotide
aacagauucaaacugccgccacaac

SEQ ID NO: 4623 - DNA, 25 bp, Artificial Sequence
  Synthetic Oligonucleotide
gccagaaauuguggaggcuguggaa

SEQ ID NO: 4624 - DNA, 25 bp, Artificial Sequence
  Synthetic Oligonucleotide
caaccgucuggaugaugugcguaac

SEQ ID NO: 4625 - DNA, 25 bp, Artificial Sequence
  Synthetic Oligonucleotide
agaagaugggcuacaaggccauatt

SEQ ID NO: 4626 - DNA, 25 bp, Artificial Sequence
  Synthetic Oligonucleotide
agacccaucuaucagcugggaagat

SEQ ID NO: 4627 - DNA, 25 bp, Artificial Sequence
  Synthetic Oligonucleotide
gcucugagugggugccagaauguga

SEQ ID NO: 4628 - DNA, 25 bp, Artificial Sequence
  Synthetic Oligonucleotide
cguuuccaagaucugacagugcaca

SEQ ID NO: 4629 - DNA, 25 bp, Artificial Sequence
  Synthetic Oligonucleotide
ggugugcggaaaggcacugaugutc

SEQ ID NO: 4630 - DNA, 25 bp, Artificial Sequence
  Synthetic Oligonucleotide
aauugaagaaguggcggaagcuggt

SEQ ID NO: 4631 - DNA, 25 bp, Artificial Sequence
  Synthetic Oligonucleotide
ugggccaccuccucaauugaagaag

SEQ ID NO: 4632 - DNA, 25 bp, Artificial Sequence
  Synthetic Oligonucleotide
cuccucaauugaagaaguggcggaa

SEQ ID NO: 4633 - DNA, 25 bp, Artificial Sequence
  Synthetic Oligonucleotide
guuaaacauggcuugaaugggauct

SEQ ID NO: 4634 - DNA, 25 bp, Artificial Sequence
  Synthetic Oligonucleotide
gccguuuccaagaucugacagugca

SEQ ID NO: 4635 - DNA, 25 bp, Artificial Sequence
  Synthetic Oligonucleotide
cucaauugaagaaguggcggaagct

SEQ ID NO: 4636 - DNA, 25 bp, Artificial Sequence
  Synthetic Oligonucleotide
uauaugacuauuacaggucuggggc

SEQ ID NO: 4637 - DNA, 25 bp, Artificial Sequence
  Synthetic Oligonucleotide
cacuucguuggcugcaacuguauat

SEQ ID NO: 4638 - DNA, 25 bp, Artificial Sequence
  Synthetic Oligonucleotide
ccugggccaccuccucaauugaaga

SEQ ID NO: 4639 - DNA, 25 bp, Artificial Sequence
  Synthetic Oligonucleotide
cuguauccaaggaugcuccggaatg

SEQ ID NO: 4640 - DNA, 25 bp, Artificial Sequence
  Synthetic Oligonucleotide
aacauggcuugaaugggaucuuggt

SEQ ID NO: 4641 - DNA, 25 bp, Artificial Sequence
  Synthetic Oligonucleotide
acugugcagagggugaccacaguct

SEQ ID NO: 4642 - DNA, 25 bp, Artificial Sequence
  Synthetic Oligonucleotide
ggaaaaauccuuuggccguuuccaa

SEQ ID NO: 4643 - DNA, 25 bp, Artificial Sequence
  Synthetic Oligonucleotide
gagaauuggaauggguggcgguaat

SEQ ID NO: 4644 - DNA, 25 bp, Artificial Sequence
  Synthetic Oligonucleotide
aagaaguggcggaagcugguccuga

SEQ ID NO: 4645 - DNA, 25 bp, Artificial Sequence
  Synthetic Oligonucleotide
uccccacuucaauacaaagggugtc

SEQ ID NO: 4646 - DNA, 25 bp, Artificial Sequence
  Synthetic Oligonucleotide
acuaaaggaagaauuccgguuggcc

SEQ ID NO: 4647 - DNA, 25 bp, Artificial Sequence
  Synthetic Oligonucleotide
uggaagggaagguggaagucuucct

SEQ ID NO: 4648 - DNA, 25 bp, Artificial Sequence
  Synthetic Oligonucleotide
ugacuauuacaggucuggggcaaat

SEQ ID NO: 4649 - DNA, 25 bp, Artificial Sequence
  Synthetic Oligonucleotide
ccacugugagagccugucaguccct

SEQ ID NO: 4650 - DNA, 25 bp, Artificial Sequence
  Synthetic Oligonucleotide
uggaauggguggcgguaauugguga

SEQ ID NO: 4651 - DNA, 25 bp, Artificial Sequence
  Synthetic Oligonucleotide
ucaauugaagaaguggcggaagctg

SEQ ID NO: 4652 - DNA, 25 bp, Artificial Sequence
  Synthetic Oligonucleotide
acucgauggggugccagccacuatt

SEQ ID NO: 4653 - DNA, 25 bp, Artificial Sequence
  Synthetic Oligonucleotide
ccuccucaauugaagaaguggcgga

SEQ ID NO: 4654 - DNA, 25 bp, Artificial Sequence
  Synthetic Oligonucleotide
aauuggaauggguggcgguaauugg

SEQ ID NO: 4655 - DNA, 25 bp, Artificial Sequence
  Synthetic Oligonucleotide
gaaaaauccuuuggccguuuccaag

SEQ ID NO: 4656 - DNA, 25 bp, Artificial Sequence
  Synthetic Oligonucleotide
aagggaagguggaagucuuccugga

SEQ ID NO: 4657 - DNA, 25 bp, Artificial Sequence
  Synthetic Oligonucleotide
cagcugggaagauaucaaauggctg

SEQ ID NO: 4658 - DNA, 25 bp, Artificial Sequence
  Synthetic Oligonucleotide
ccucaauugaagaaguggcggaagc

SEQ ID NO: 4659 - DNA, 25 bp, Artificial Sequence
  Synthetic Oligonucleotide
acuucuguuuuaggacagaggguca

SEQ ID NO: 4660 - DNA, 25 bp, Artificial Sequence
  Synthetic Oligonucleotide
cacuggagagaauuggaaugggugg

SEQ ID NO: 4661 - DNA, 25 bp, Artificial Sequence
  Synthetic Oligonucleotide
caaucguuuggggcuuagcuuucca

SEQ ID NO: 4662 - DNA, 25 bp, Artificial Sequence
  Synthetic Oligonucleotide
gccaccuccucaauugaagaagugg

SEQ ID NO: 4663 - DNA, 25 bp, Artificial Sequence
  Synthetic Oligonucleotide
uguuaaacauggcuugaaugggatc

SEQ ID NO: 4664 - DNA, 25 bp, Artificial Sequence
  Synthetic Oligonucleotide
ugauguucugaaagcucuggcuctt

SEQ ID NO: 4665 - DNA, 25 bp, Artificial Sequence
  Synthetic Oligonucleotide
gcguaacagauucaaacugccgcca

SEQ ID NO: 4666 - DNA, 25 bp, Artificial Sequence
  Synthetic Oligonucleotide
uucaaacugccgccacaacucagga

SEQ ID NO: 4667 - DNA, 25 bp, Artificial Sequence
  Synthetic Oligonucleotide
uuggaauggguggcgguaauuggtg

SEQ ID NO: 4668 - DNA, 25 bp, Artificial Sequence
  Synthetic Oligonucleotide
aggaaaaauccuuuggccguuucca

SEQ ID NO: 4669 - DNA, 25 bp, Artificial Sequence
  Synthetic Oligonucleotide
ggcaggcuaaagugcuguauccutt

SEQ ID NO: 4670 - DNA, 25 bp, Artificial Sequence
  Synthetic Oligonucleotide
ugaugccagggaggcuguuaaacat

SEQ ID NO: 4671 - DNA, 25 bp, Artificial Sequence
  Synthetic Oligonucleotide
ugccacugugagagccugucagucc

SEQ ID NO: 4672 - DNA, 25 bp, Artificial Sequence
  Synthetic Oligonucleotide
auuuugagaggugaugaugccaggg

SEQ ID NO: 4673 - DNA, 25 bp, Artificial Sequence
  Synthetic Oligonucleotide
uuccugggccaccuccucaauugaa

SEQ ID NO: 4674 - DNA, 25 bp, Artificial Sequence
  Synthetic Oligonucleotide
auaugacuauuacaggucuggggca

SEQ ID NO: 4675 - DNA, 25 bp, Artificial Sequence
  Synthetic Oligonucleotide
caguggacuugcugcauauguggct

SEQ ID NO: 4676 - DNA, 25 bp, Artificial Sequence
  Synthetic Oligonucleotide
uuuagacaacgucauccccuggcag

SEQ ID NO: 4677 - DNA, 25 bp, Artificial Sequence
  Synthetic Oligonucleotide
uucugccagaaauuguggaggcugt

SEQ ID NO: 4678 - DNA, 25 bp, Artificial Sequence
  Synthetic Oligonucleotide
cucgauggggugccagccacuautg

SEQ ID NO: 4679 - DNA, 25 bp, Artificial Sequence
  Synthetic Oligonucleotide
gaagucaccaagaagcuagugcggc

SEQ ID NO: 4680 - DNA, 25 bp, Artificial Sequence
  Synthetic Oligonucleotide
ugugcggaaaggcacugauguuctg

SEQ ID NO: 4681 - DNA, 25 bp, Artificial Sequence
  Synthetic Oligonucleotide
aggcuguuaaacauggcuugaaugg

SEQ ID NO: 4682 - DNA, 25 bp, Artificial Sequence
  Synthetic Oligonucleotide
guggaggcuguggaagggaaggugg

SEQ ID NO: 4683 - DNA, 25 bp, Artificial Sequence
  Synthetic Oligonucleotide
uggugucgaaucauggggcucgaca

SEQ ID NO: 4684 - DNA, 25 bp, Artificial Sequence
  Synthetic Oligonucleotide
ucaaacugccgccacaacucaggat

SEQ ID NO: 4685 - DNA, 25 bp, Artificial Sequence
  Synthetic Oligonucleotide
gaugaugccagggaggcuguuaaac

SEQ ID NO: 4686 - DNA, 25 bp, Artificial Sequence
  Synthetic Oligonucleotide
augacuauuacaggucuggggcaaa

SEQ ID NO: 4687 - DNA, 25 bp, Artificial Sequence
  Synthetic Oligonucleotide
gacaacucgauggggugccagccac

SEQ ID NO: 4688 - DNA, 25 bp, Artificial Sequence
  Synthetic Oligonucleotide
ggugaggaaaaauccuuuggccgtt

SEQ ID NO: 4689 - DNA, 25 bp, Artificial Sequence
  Synthetic Oligonucleotide
aaaggaagaauuccgguuggccatg

SEQ ID NO: 4690 - DNA, 25 bp, Artificial Sequence
  Synthetic Oligonucleotide
guaacagauucaaacugccgccaca

SEQ ID NO: 4691 - DNA, 25 bp, Artificial Sequence
  Synthetic Oligonucleotide
uugccacugugagagccugucagtc

SEQ ID NO: 4692 - DNA, 25 bp, Artificial Sequence
  Synthetic Oligonucleotide
ugggaacgggcaugauguugagutc

SEQ ID NO: 4693 - DNA, 25 bp, Artificial Sequence
  Synthetic Oligonucleotide
ugccagaaauuguggaggcugugga

SEQ ID NO: 4694 - DNA, 25 bp, Artificial Sequence
  Synthetic Oligonucleotide
uaugacuauuacaggucuggggcaa

SEQ ID NO: 4695 - DNA, 25 bp, Artificial Sequence
  Synthetic Oligonucleotide
acgggcaugauguugaguuccuggg

SEQ ID NO: 4696 - DNA, 25 bp, Artificial Sequence
  Synthetic Oligonucleotide
ggcuguuaaacauggcuugaauggg

SEQ ID NO: 4697 - DNA, 25 bp, Artificial Sequence
  Synthetic Oligonucleotide
cacugauguucugaaagcucuggct

SEQ ID NO: 4698 - DNA, 25 bp, Artificial Sequence
  Synthetic Oligonucleotide
gggaucuuggugucgaaucaugggg

SEQ ID NO: 4699 - DNA, 25 bp, Artificial Sequence
  Synthetic Oligonucleotide
accaaucguuuggggcuuagcuutc

SEQ ID NO: 4700 - DNA, 25 bp, Artificial Sequence
  Synthetic Oligonucleotide
gacaacgucauccccuggcaggcta

SEQ ID NO: 4701 - DNA, 25 bp, Artificial Sequence
  Synthetic Oligonucleotide
ugugcagagggugaccacagucugt

SEQ ID NO: 4702 - DNA, 25 bp, Artificial Sequence
  Synthetic Oligonucleotide
ucgauggggugccagccacuauuga

SEQ ID NO: 4703 - DNA, 25 bp, Artificial Sequence
  Synthetic Oligonucleotide
accugggcaaccgucuggaugaugt

SEQ ID NO: 4704 - DNA, 25 bp, Artificial Sequence
  Synthetic Oligonucleotide
gaagcuguauccaaggaugcuccgg

SEQ ID NO: 4705 - DNA, 25 bp, Artificial Sequence
  Synthetic Oligonucleotide
gugucgaaucauggggcucgacaac

SEQ ID NO: 4706 - DNA, 25 bp, Artificial Sequence
  Synthetic Oligonucleotide
gacuauuacaggucuggggcaaatg

SEQ ID NO: 4707 - DNA, 25 bp, Artificial Sequence
  Synthetic Oligonucleotide
ccugggcaaccgucuggaugaugtg

SEQ ID NO: 4708 - DNA, 25 bp, Artificial Sequence
  Synthetic Oligonucleotide
gucgaaucauggggcucgacaactc

SEQ ID NO: 4709 - DNA, 25 bp, Artificial Sequence
  Synthetic Oligonucleotide
ccaccuccucaauugaagaaguggc

SEQ ID NO: 4710 - DNA, 25 bp, Artificial Sequence
  Synthetic Oligonucleotide
ggcuguggaagggaagguggaagtc

SEQ ID NO: 4711 - DNA, 25 bp, Artificial Sequence
  Synthetic Oligonucleotide
uuuaggacagagggucagcaugcca

SEQ ID NO: 4712 - DNA, 25 bp, Artificial Sequence
  Synthetic Oligonucleotide
aaaaauccuuuggccguuuccaaga

SEQ ID NO: 4713 - DNA, 25 bp, Artificial Sequence
  Synthetic Oligonucleotide
gauguucugaaagcucuggcucutg

SEQ ID NO: 4714 - DNA, 25 bp, Artificial Sequence
  Synthetic Oligonucleotide
cuucuguuuuaggacagagggucag

SEQ ID NO: 4715 - DNA, 25 bp, Artificial Sequence
  Synthetic Oligonucleotide
gggaagguggaagucuuccuggacg

SEQ ID NO: 4716 - DNA, 25 bp, Artificial Sequence
  Synthetic Oligonucleotide
ucuccugaggaaaauuuuggagacg

SEQ ID NO: 4717 - DNA, 25 bp, Artificial Sequence
  Synthetic Oligonucleotide
agaagcuagugcggcaggcagagaa

SEQ ID NO: 4718 - DNA, 25 bp, Artificial Sequence
  Synthetic Oligonucleotide
uguggaagggaagguggaagucutc

SEQ ID NO: 4719 - DNA, 25 bp, Artificial Sequence
  Synthetic Oligonucleotide
gaggcacuucguuggcugcaacugt

SEQ ID NO: 4720 - DNA, 25 bp, Artificial Sequence
  Synthetic Oligonucleotide
ugcguaacagauucaaacugccgcc

SEQ ID NO: 4721 - DNA, 25 bp, Artificial Sequence
  Synthetic Oligonucleotide
cuuuggccguuuccaagaucugaca

SEQ ID NO: 4722 - DNA, 25 bp, Artificial Sequence
  Synthetic Oligonucleotide
ucgaaucauggggcucgacaacucg

SEQ ID NO: 4723 - DNA, 25 bp, Artificial Sequence
  Synthetic Oligonucleotide
uggccguuuccaagaucugacagtg

SEQ ID NO: 4724 - DNA, 25 bp, Artificial Sequence
  Synthetic Oligonucleotide
cgucauccccuggcaggcuaaagtg

SEQ ID NO: 4725 - DNA, 25 bp, Artificial Sequence
  Synthetic Oligonucleotide
gugaggaaaaauccuuuggccgutt

SEQ ID NO: 4726 - DNA, 25 bp, Artificial Sequence
  Synthetic Oligonucleotide
ugaugaugccagggaggcuguuaaa

SEQ ID NO: 4727 - DNA, 25 bp, Artificial Sequence
  Synthetic Oligonucleotide
uaaaggaagaauuccgguuggccat

SEQ ID NO: 4728 - DNA, 25 bp, Artificial Sequence
  Synthetic Oligonucleotide
uucuguuuuaggacagagggucagc

SEQ ID NO: 4729 - DNA, 25 bp, Artificial Sequence
  Synthetic Oligonucleotide
uuuggccguuuccaagaucugacag

SEQ ID NO: 4730 - DNA, 25 bp, Artificial Sequence
  Synthetic Oligonucleotide
accuccucaauugaagaaguggcgg

SEQ ID NO: 4731 - DNA, 25 bp, Artificial Sequence
  Synthetic Oligonucleotide
ccuuuggccguuuccaagaucugac

SEQ ID NO: 4732 - DNA, 25 bp, Artificial Sequence
  Synthetic Oligonucleotide
ugucgaaucauggggcucgacaact

SEQ ID NO: 4733 - DNA, 25 bp, Artificial Sequence
  Synthetic Oligonucleotide
aggcuguggaagggaagguggaagt

SEQ ID NO: 4734 - DNA, 25 bp, Artificial Sequence
  Synthetic Oligonucleotide
uguggaggcuguggaagggaaggtg

SEQ ID NO: 4735 - DNA, 25 bp, Artificial Sequence
  Synthetic Oligonucleotide
aaucguuuggggcuuagcuuuccag

SEQ ID NO: 4736 - DNA, 25 bp, Artificial Sequence
  Synthetic Oligonucleotide
cagaaauuguggaggcuguggaagg

SEQ ID NO: 4737 - DNA, 25 bp, Artificial Sequence
  Synthetic Oligonucleotide
cugggcaaccgucuggaugaugugc

SEQ ID NO: 4738 - DNA, 25 bp, Artificial Sequence
  Synthetic Oligonucleotide
gaagcugguccugaggcacuucgtt

SEQ ID NO: 4739 - DNA, 25 bp, Artificial Sequence
  Synthetic Oligonucleotide
acauggcuugaaugggaucuuggtg

SEQ ID NO: 4740 - DNA, 25 bp, Artificial Sequence
  Synthetic Oligonucleotide
ggcacuucguuggcugcaacuguat

SEQ ID NO: 4741 - DNA, 25 bp, Artificial Sequence
  Synthetic Oligonucleotide
gugagagccugucagucccugggaa

SEQ ID NO: 4742 - DNA, 25 bp, Artificial Sequence
  Synthetic Oligonucleotide
augccagggaggcuguuaaacaugg

SEQ ID NO: 4743 - DNA, 25 bp, Artificial Sequence
  Synthetic Oligonucleotide
uuggugaggaaaaauccuuuggccg

SEQ ID NO: 4744 - DNA, 25 bp, Artificial Sequence
  Synthetic Oligonucleotide
cacugugagagccugucaguccctg

SEQ ID NO: 4745 - DNA, 25 bp, Artificial Sequence
  Synthetic Oligonucleotide
gacggcgagcuugccacugugagag

SEQ ID NO: 4746 - DNA, 25 bp, Artificial Sequence
  Synthetic Oligonucleotide
aagcugguccugaggcacuucgutg

SEQ ID NO: 4747 - DNA, 25 bp, Artificial Sequence
  Synthetic Oligonucleotide
ccugggaacgggcaugauguugagt

SEQ ID NO: 4748 - DNA, 25 bp, Artificial Sequence
  Synthetic Oligonucleotide
ugggaucuuggugucgaaucauggg

SEQ ID NO: 4749 - DNA, 25 bp, Artificial Sequence
  Synthetic Oligonucleotide
guuccugggccaccuccucaauuga

SEQ ID NO: 4750 - DNA, 25 bp, Artificial Sequence
  Synthetic Oligonucleotide
aaaauccuuuggccguuuccaagat

SEQ ID NO: 4751 - DNA, 25 bp, Artificial Sequence
  Synthetic Oligonucleotide
agggaagguggaagucuuccuggac

SEQ ID NO: 4752 - DNA, 25 bp, Artificial Sequence
  Synthetic Oligonucleotide
gaguuccugggccaccuccucaatt

SEQ ID NO: 4753 - DNA, 25 bp, Artificial Sequence
  Synthetic Oligonucleotide
auugaagaaguggcggaagcuggtc

SEQ ID NO: 4754 - DNA, 25 bp, Artificial Sequence
  Synthetic Oligonucleotide
aucguuuggggcuuagcuuuccagg

SEQ ID NO: 4755 - DNA, 25 bp, Artificial Sequence
  Synthetic Oligonucleotide
uuggccguuuccaagaucugacagt

SEQ ID NO: 4756 - DNA, 25 bp, Artificial Sequence
  Synthetic Oligonucleotide
ggaagaauuccgguuggccauggct

SEQ ID NO: 4757 - DNA, 25 bp, Artificial Sequence
  Synthetic Oligonucleotide
agggaggcuguuaaacauggcuuga

SEQ ID NO: 4758 - DNA, 25 bp, Artificial Sequence
  Synthetic Oligonucleotide
guuuguggggagaccaaucguuugg

SEQ ID NO: 4759 - DNA, 25 bp, Artificial Sequence
  Synthetic Oligonucleotide
agaaauuguggaggcuguggaaggg

SEQ ID NO: 4760 - DNA, 25 bp, Artificial Sequence
  Synthetic Oligonucleotide
caggcuaaagugcuguauccuuuag

SEQ ID NO: 4761 - DNA, 25 bp, Artificial Sequence
  Synthetic Oligonucleotide
gagaagaugggcuacaaggccauat

SEQ ID NO: 4762 - DNA, 25 bp, Artificial Sequence
  Synthetic Oligonucleotide
aagucaccaagaagcuagugcggca

SEQ ID NO: 4763 - DNA, 25 bp, Artificial Sequence
  Synthetic Oligonucleotide
guggacggcgagcuugccacuguga

SEQ ID NO: 4764 - DNA, 25 bp, Artificial Sequence
  Synthetic Oligonucleotide
acugugagagccugucagucccugg

SEQ ID NO: 4765 - DNA, 25 bp, Artificial Sequence
  Synthetic Oligonucleotide
uuuucaauggguguccuaggaacct

SEQ ID NO: 4766 - DNA, 25 bp, Artificial Sequence
  Synthetic Oligonucleotide
uguauccaaggaugcuccggaaugt

SEQ ID NO: 4767 - DNA, 25 bp, Artificial Sequence
  Synthetic Oligonucleotide
guugaguuccugggccaccuccuca

SEQ ID NO: 4768 - DNA, 25 bp, Artificial Sequence
  Synthetic Oligonucleotide
aaauccuuuggccguuuccaagatc

SEQ ID NO: 4769 - DNA, 25 bp, Artificial Sequence
  Synthetic Oligonucleotide
uggcaggcuaaagugcuguaucctt

SEQ ID NO: 4770 - DNA, 25 bp, Artificial Sequence
  Synthetic Oligonucleotide
aauccuuuggccguuuccaagauct

SEQ ID NO: 4771 - DNA, 25 bp, Artificial Sequence
  Synthetic Oligonucleotide
aauuguggaggcuguggaagggaag

SEQ ID NO: 4772 - DNA, 25 bp, Artificial Sequence
  Synthetic Oligonucleotide
ggagagaauuggaauggguggcggt

SEQ ID NO: 4773 - DNA, 25 bp, Artificial Sequence
  Synthetic Oligonucleotide
gauguugaguuccugggccaccucc

SEQ ID NO: 4774 - DNA, 25 bp, Artificial Sequence
  Synthetic Oligonucleotide
uguucugccagaaauuguggaggct

SEQ ID NO: 4775 - DNA, 25 bp, Artificial Sequence
  Synthetic Oligonucleotide
aagcuagugcggcaggcagagaaga

SEQ ID NO: 4776 - DNA, 25 bp, Artificial Sequence
  Synthetic Oligonucleotide
gaaucauggggcucgacaacucgat

SEQ ID NO: 4777 - DNA, 25 bp, Artificial Sequence
  Synthetic Oligonucleotide
ccagggaggcuguuaaacauggctt

SEQ ID NO: 4778 - DNA, 25 bp, Artificial Sequence
  Synthetic Oligonucleotide
cuggagagaauuggaauggguggcg

SEQ ID NO: 4779 - DNA, 25 bp, Artificial Sequence
  Synthetic Oligonucleotide
agagaagaugggcuacaaggccata

SEQ ID NO: 4780 - DNA, 25 bp, Artificial Sequence
  Synthetic Oligonucleotide
agaccaaucguuuggggcuuagctt

SEQ ID NO: 4781 - DNA, 25 bp, Artificial Sequence
  Synthetic Oligonucleotide
uuguggaggcuguggaagggaaggt

SEQ ID NO: 4782 - DNA, 25 bp, Artificial Sequence
  Synthetic Oligonucleotide
aaucauggggcucgacaacucgatg

SEQ ID NO: 4783 - DNA, 25 bp, Artificial Sequence
  Synthetic Oligonucleotide
ccugaggcacuucguuggcugcaac

SEQ ID NO: 4784 - DNA, 25 bp, Artificial Sequence
  Synthetic Oligonucleotide
ucccugggaacgggcaugauguuga

SEQ ID NO: 4785 - DNA, 25 bp, Artificial Sequence
  Synthetic Oligonucleotide
ugugagagccugucagucccuggga

SEQ ID NO: 4786 - DNA, 25 bp, Artificial Sequence
  Synthetic Oligonucleotide
gagagaauuggaauggguggcggta

SEQ ID NO: 4787 - DNA, 25 bp, Artificial Sequence
  Synthetic Oligonucleotide
ggcucugagugggugccagaaugtg

SEQ ID NO: 4788 - DNA, 25 bp, Artificial Sequence
  Synthetic Oligonucleotide
agucaccaagaagcuagugcggcag

SEQ ID NO: 4789 - DNA, 25 bp, Artificial Sequence
  Synthetic Oligonucleotide
aaggaagaauuccgguuggccaugg

SEQ ID NO: 4790 - DNA, 25 bp, Artificial Sequence
  Synthetic Oligonucleotide
ggccguuuccaagaucugacagugc

SEQ ID NO: 4791 - DNA, 25 bp, Artificial Sequence
  Synthetic Oligonucleotide
uccuuuggccguuuccaagaucuga

SEQ ID NO: 4792 - DNA, 25 bp, Artificial Sequence
  Synthetic Oligonucleotide
gcaggcagagaagaugggcuacaag

SEQ ID NO: 4793 - DNA, 25 bp, Artificial Sequence
  Synthetic Oligonucleotide
ugagagccugucagucccugggaac

SEQ ID NO: 4794 - DNA, 25 bp, Artificial Sequence
  Synthetic Oligonucleotide
ucugccagaaauuguggaggcugtg

SEQ ID NO: 4795 - DNA, 25 bp, Artificial Sequence
  Synthetic Oligonucleotide
gaagcuagugcggcaggcagagaag

SEQ ID NO: 4796 - DNA, 25 bp, Artificial Sequence
  Synthetic Oligonucleotide
auucaaacugccgccacaacucagg

SEQ ID NO: 4797 - DNA, 25 bp, Artificial Sequence
  Synthetic Oligonucleotide
uuuguggggagaccaaucguuuggg

SEQ ID NO: 4798 - DNA, 25 bp, Artificial Sequence
  Synthetic Oligonucleotide
uuuuaggacagagggucagcaugcc

SEQ ID NO: 4799 - DNA, 25 bp, Artificial Sequence
  Synthetic Oligonucleotide
ggaagguggaagucuuccuggacgg

SEQ ID NO: 4800 - DNA, 25 bp, Artificial Sequence
  Synthetic Oligonucleotide
uggugaggaaaaauccuuuggccgt

SEQ ID NO: 4801 - DNA, 25 bp, Artificial Sequence
  Synthetic Oligonucleotide
acaacgucauccccuggcaggcuaa

SEQ ID NO: 4802 - DNA, 25 bp, Artificial Sequence
  Synthetic Oligonucleotide
uuagacaacgucauccccuggcagg

SEQ ID NO: 4803 - DNA, 25 bp, Artificial Sequence
  Synthetic Oligonucleotide
ugaggaaaaauccuuuggccguutc

SEQ ID NO: 4804 - DNA, 25 bp, Artificial Sequence
  Synthetic Oligonucleotide
caggcagagaagaugggcuacaagg

SEQ ID NO: 4805 - DNA, 25 bp, Artificial Sequence
  Synthetic Oligonucleotide
caccuccucaauugaagaaguggcg

SEQ ID NO: 4806 - DNA, 25 bp, Artificial Sequence
  Synthetic Oligonucleotide
ugauguugaguuccugggccacctc

SEQ ID NO: 4807 - DNA, 25 bp, Artificial Sequence
  Synthetic Oligonucleotide
agagaauuggaauggguggcgguaa

SEQ ID NO: 4808 - DNA, 25 bp, Artificial Sequence
  Synthetic Oligonucleotide
uccucaauugaagaaguggcggaag

SEQ ID NO: 4809 - DNA, 25 bp, Artificial Sequence
  Synthetic Oligonucleotide
uggagagaauuggaauggguggcgg

SEQ ID NO: 4810 - DNA, 25 bp, Artificial Sequence
  Synthetic Oligonucleotide
cccuggcaggcuaaagugcuguatc

SEQ ID NO: 4811 - DNA, 25 bp, Artificial Sequence
  Synthetic Oligonucleotide
gaggcuguggaagggaagguggaag

SEQ ID NO: 4812 - DNA, 25 bp, Artificial Sequence
  Synthetic Oligonucleotide
uggcucugagugggugccagaaugt

SEQ ID NO: 4813 - DNA, 25 bp, Artificial Sequence
  Synthetic Oligonucleotide
gucaccaagaagcuagugcggcagg

SEQ ID NO: 4814 - DNA, 25 bp, Artificial Sequence
  Synthetic Oligonucleotide
gaagaaguggcggaagcuggucctg

SEQ ID NO: 4815 - DNA, 25 bp, Artificial Sequence
  Synthetic Oligonucleotide
aguuccugggccaccuccucaautg

SEQ ID NO: 4816 - DNA, 25 bp, Artificial Sequence
  Synthetic Oligonucleotide
cugaggcacuucguuggcugcaact

SEQ ID NO: 4817 - DNA, 25 bp, Artificial Sequence
  Synthetic Oligonucleotide
uccugggccaccuccucaauugaag

SEQ ID NO: 4818 - DNA, 25 bp, Artificial Sequence
  Synthetic Oligonucleotide
uggaggcuguggaagggaaggugga

SEQ ID NO: 4819 - DNA, 25 bp, Artificial Sequence
  Synthetic Oligonucleotide
cuuggugucgaaucauggggcucga

SEQ ID NO: 4820 - DNA, 25 bp, Artificial Sequence
  Synthetic Oligonucleotide
ggaggcuguggaagggaagguggaa

SEQ ID NO: 4821 - DNA, 25 bp, Artificial Sequence
  Synthetic Oligonucleotide
ggaucuuggugucgaaucauggggc

SEQ ID NO: 4822 - DNA, 25 bp, Artificial Sequence
  Synthetic Oligonucleotide
cccugggaacgggcaugauguugag

SEQ ID NO: 4823 - DNA, 25 bp, Artificial Sequence
  Synthetic Oligonucleotide
uugagaggugaugaugccagggagg

SEQ ID NO: 4824 - DNA, 25 bp, Artificial Sequence
  Synthetic Oligonucleotide
uggcuugaaugggaucuuggugucg

SEQ ID NO: 4825 - DNA, 25 bp, Artificial Sequence
  Synthetic Oligonucleotide
auggcucugagugggugccagaatg

SEQ ID NO: 4826 - DNA, 25 bp, Artificial Sequence
  Synthetic Oligonucleotide
gaggugaugaugccagggaggcugt

SEQ ID NO: 4827 - DNA, 25 bp, Artificial Sequence
  Synthetic Oligonucleotide
gagcuugccacugugagagccugtc

SEQ ID NO: 4828 - DNA, 25 bp, Artificial Sequence
  Synthetic Oligonucleotide
uugaguuccugggccaccuccucaa

SEQ ID NO: 4829 - DNA, 25 bp, Artificial Sequence
  Synthetic Oligonucleotide
gcgagcuugccacugugagagcctg

SEQ ID NO: 4830 - DNA, 25 bp, Artificial Sequence
  Synthetic Oligonucleotide
uguggacggcgagcuugccacugtg

SEQ ID NO: 4831 - DNA, 25 bp, Artificial Sequence
  Synthetic Oligonucleotide
auuguggaggcuguggaagggaagg

SEQ ID NO: 4832 - DNA, 25 bp, Artificial Sequence
  Synthetic Oligonucleotide
uugaagaaguggcggaagcuggucc

SEQ ID NO: 4833 - DNA, 25 bp, Artificial Sequence
  Synthetic Oligonucleotide
caacucgauggggugccagccacta

SEQ ID NO: 4834 - DNA, 25 bp, Artificial Sequence
  Synthetic Oligonucleotide
gaagaauuccgguuggccauggctc

SEQ ID NO: 4835 - DNA, 25 bp, Artificial Sequence
  Synthetic Oligonucleotide
gcagagaagaugggcuacaaggcca

SEQ ID NO: 4836 - DNA, 25 bp, Artificial Sequence
  Synthetic Oligonucleotide
ccaaucguuuggggcuuagcuuucc

SEQ ID NO: 4837 - DNA, 25 bp, Artificial Sequence
  Synthetic Oligonucleotide
gaggaaaaauccuuuggccguuucc

SEQ ID NO: 4838 - DNA, 25 bp, Artificial Sequence
  Synthetic Oligonucleotide
acgucauccccuggcaggcuaaagt

SEQ ID NO: 4839 - DNA, 25 bp, Artificial Sequence
  Synthetic Oligonucleotide
cugugagagccugucagucccuggg

SEQ ID NO: 4840 - DNA, 25 bp, Artificial Sequence
  Synthetic Oligonucleotide
gucauccccuggcaggcuaaagugc

SEQ ID NO: 4841 - DNA, 25 bp, Artificial Sequence
  Synthetic Oligonucleotide
caacgucauccccuggcaggcuaaa

SEQ ID NO: 4842 - DNA, 25 bp, Artificial Sequence
  Synthetic Oligonucleotide
aucauggggcucgacaacucgaugg

SEQ ID NO: 4843 - DNA, 25 bp, Artificial Sequence
  Synthetic Oligonucleotide
auccuuuggccguuuccaagauctg

SEQ ID NO: 4844 - DNA, 25 bp, Artificial Sequence
  Synthetic Oligonucleotide
ccuggcaggcuaaagugcuguaucc

SEQ ID NO: 4845 - DNA, 25 bp, Artificial Sequence
  Synthetic Oligonucleotide
uuggugucgaaucauggggcucgac

SEQ ID NO: 4846 - DNA, 25 bp, Artificial Sequence
  Synthetic Oligonucleotide
auguggacggcgagcuugccacugt

SEQ ID NO: 4847 - DNA, 25 bp, Artificial Sequence
  Synthetic Oligonucleotide
gaauuccgguuggccauggcucuga

SEQ ID NO: 4848 - DNA, 25 bp, Artificial Sequence
  Synthetic Oligonucleotide
accaagaagcuagugcggcaggcag

SEQ ID NO: 4849 - DNA, 25 bp, Artificial Sequence
  Synthetic Oligonucleotide
aagguggaagucuuccuggacgggg

SEQ ID NO: 4850 - DNA, 25 bp, Artificial Sequence
  Synthetic Oligonucleotide
auguugaguuccugggccaccucct

SEQ ID NO: 4851 - DNA, 25 bp, Artificial Sequence
  Synthetic Oligonucleotide
cuuaccugggcaaccgucuggauga

SEQ ID NO: 4852 - DNA, 25 bp, Artificial Sequence
  Synthetic Oligonucleotide
acaacucgauggggugccagccact

SEQ ID NO: 4853 - DNA, 25 bp, Artificial Sequence
  Synthetic Oligonucleotide
agaggugaugaugccagggaggctg

SEQ ID NO: 4854 - DNA, 25 bp, Artificial Sequence
  Synthetic Oligonucleotide
gggcaaccgucuggaugaugugcgt

SEQ ID NO: 4855 - DNA, 25 bp, Artificial Sequence
  Synthetic Oligonucleotide
cuggcaggcuaaagugcuguaucct

SEQ ID NO: 4856 - DNA, 25 bp, Artificial Sequence
  Synthetic Oligonucleotide
cgagcuugccacugugagagccugt

SEQ ID NO: 4857 - DNA, 25 bp, Artificial Sequence
  Synthetic Oligonucleotide
agaaguggcggaagcugguccugag

SEQ ID NO: 4858 - DNA, 25 bp, Artificial Sequence
  Synthetic Oligonucleotide
cuagugcggcaggcagagaagaugg

SEQ ID NO: 4859 - DNA, 25 bp, Artificial Sequence
  Synthetic Oligonucleotide
uuguggggagaccaaucguuugggg

SEQ ID NO: 4860 - DNA, 25 bp, Artificial Sequence
  Synthetic Oligonucleotide
aauuccgguuggccauggcucugag

SEQ ID NO: 4861 - DNA, 25 bp, Artificial Sequence
  Synthetic Oligonucleotide
augauguugaguuccugggccacct

SEQ ID NO: 4862 - DNA, 25 bp, Artificial Sequence
  Synthetic Oligonucleotide
ggugaugaugccagggaggcuguta

SEQ ID NO: 4863 - DNA, 25 bp, Artificial Sequence
  Synthetic Oligonucleotide
agcuagugcggcaggcagagaagat

SEQ ID NO: 4864 - DNA, 25 bp, Artificial Sequence
  Synthetic Oligonucleotide
aacucgauggggugccagccacuat

SEQ ID NO: 4865 - DNA, 25 bp, Artificial Sequence
  Synthetic Oligonucleotide
acggcgagcuugccacugugagagc

SEQ ID NO: 4866 - DNA, 25 bp, Artificial Sequence
  Synthetic Oligonucleotide
aggaagaauuccgguuggccauggc

SEQ ID NO: 4867 - DNA, 25 bp, Artificial Sequence
  Synthetic Oligonucleotide
cucgacaacucgauggggugccagc

SEQ ID NO: 4868 - DNA, 25 bp, Artificial Sequence
  Synthetic Oligonucleotide
acuggagagaauuggaauggguggc

SEQ ID NO: 4869 - DNA, 25 bp, Artificial Sequence
  Synthetic Oligonucleotide
aggugaugaugccagggaggcugtt

SEQ ID NO: 4870 - DNA, 25 bp, Artificial Sequence
  Synthetic Oligonucleotide
cugccagaaauuguggaggcugugg

SEQ ID NO: 4871 - DNA, 25 bp, Artificial Sequence
  Synthetic Oligonucleotide
ugaagaaguggcggaagcuggucct

SEQ ID NO: 4872 - DNA, 25 bp, Artificial Sequence
  Synthetic Oligonucleotide
gagaccaaucguuuggggcuuagct

SEQ ID NO: 4873 - DNA, 25 bp, Artificial Sequence
  Synthetic Oligonucleotide
ggacggcgagcuugccacugugaga

SEQ ID NO: 4874 - DNA, 25 bp, Artificial Sequence
  Synthetic Oligonucleotide
caccuuaccugggcaaccgucugga

SEQ ID NO: 4875 - DNA, 25 bp, Artificial Sequence
  Synthetic Oligonucleotide
gaucuuggugucgaaucauggggct

SEQ ID NO: 4876 - DNA, 25 bp, Artificial Sequence
  Synthetic Oligonucleotide
ccaagaagcuagugcggcaggcaga

SEQ ID NO: 4877 - DNA, 25 bp, Artificial Sequence
  Synthetic Oligonucleotide
ugaguuccugggccaccuccucaat

SEQ ID NO: 4878 - DNA, 25 bp, Artificial Sequence
  Synthetic Oligonucleotide
agucccugggaacgggcaugaugtt

SEQ ID NO: 4879 - DNA, 25 bp, Artificial Sequence
  Synthetic Oligonucleotide
cgacaacucgauggggugccagcca

SEQ ID NO: 4880 - DNA, 25 bp, Artificial Sequence
  Synthetic Oligonucleotide
aucuuggugucgaaucauggggctc

SEQ ID NO: 4881 - DNA, 25 bp, Artificial Sequence
  Synthetic Oligonucleotide
gcuagugcggcaggcagagaagatg

SEQ ID NO: 4882 - DNA, 25 bp, Artificial Sequence
  Synthetic Oligonucleotide
cggcgagcuugccacugugagagcc

SEQ ID NO: 4883 - DNA, 25 bp, Artificial Sequence
  Synthetic Oligonucleotide
ugaggcacuucguuggcugcaactg

SEQ ID NO: 4884 - DNA, 25 bp, Artificial Sequence
  Synthetic Oligonucleotide
ggcaugauguugaguuccugggcca

SEQ ID NO: 4885 - DNA, 25 bp, Artificial Sequence
  Synthetic Oligonucleotide
ggcgagcuugccacugugagagcct

SEQ ID NO: 4886 - DNA, 25 bp, Artificial Sequence
  Synthetic Oligonucleotide
gagagccugucagucccugggaacg

SEQ ID NO: 4887 - DNA, 25 bp, Artificial Sequence
  Synthetic Oligonucleotide
ucagucccugggaacgggcaugatg

SEQ ID NO: 4888 - DNA, 25 bp, Artificial Sequence
  Synthetic Oligonucleotide
ccguuuccaagaucugacagugcac

SEQ ID NO: 4889 - DNA, 25 bp, Artificial Sequence
  Synthetic Oligonucleotide
cagagaagaugggcuacaaggccat

SEQ ID NO: 4890 - DNA, 25 bp, Artificial Sequence
  Synthetic Oligonucleotide
cgggcaugauguugaguuccugggc

SEQ ID NO: 4891 - DNA, 25 bp, Artificial Sequence
  Synthetic Oligonucleotide
uaccugggcaaccgucuggaugatg

SEQ ID NO: 4892 - DNA, 25 bp, Artificial Sequence
  Synthetic Oligonucleotide
gucccugggaacgggcaugaugutg

SEQ ID NO: 4893 - DNA, 25 bp, Artificial Sequence
  Synthetic Oligonucleotide
agcugguccugaggcacuucguugg

SEQ ID NO: 4894 - DNA, 25 bp, Artificial Sequence
  Synthetic Oligonucleotide
gaagguggaagucuuccuggacggg

SEQ ID NO: 4895 - DNA, 25 bp, Artificial Sequence
  Synthetic Oligonucleotide
cagucccugggaacgggcaugaugt

SEQ ID NO: 4896 - DNA, 25 bp, Artificial Sequence
  Synthetic Oligonucleotide
agagccugucagucccugggaacgg

SEQ ID NO: 4897 - DNA, 25 bp, Artificial Sequence
  Synthetic Oligonucleotide
ccuuaccugggcaaccgucuggatg

SEQ ID NO: 4898 - DNA, 25 bp, Artificial Sequence
  Synthetic Oligonucleotide
auggggcucgacaacucgauggggt

SEQ ID NO: 4899 - DNA, 25 bp, Artificial Sequence
  Synthetic Oligonucleotide
augcagcgcauggcucauguggacg

SEQ ID NO: 4900 - DNA, 25 bp, Artificial Sequence
  Synthetic Oligonucleotide
ggagaccaaucguuuggggcuuagc

SEQ ID NO: 4901 - DNA, 25 bp, Artificial Sequence
  Synthetic Oligonucleotide
auccccuggcaggcuaaagugcugt

SEQ ID NO: 4902 - DNA, 25 bp, Artificial Sequence
  Synthetic Oligonucleotide
guggggagaccaaucguuuggggct

SEQ ID NO: 4903 - DNA, 25 bp, Artificial Sequence
  Synthetic Oligonucleotide
aagaagcuagugcggcaggcagaga

SEQ ID NO: 4904 - DNA, 25 bp, Artificial Sequence
  Synthetic Oligonucleotide
aacgucauccccuggcaggcuaaag

SEQ ID NO: 4905 - DNA, 25 bp, Artificial Sequence
  Synthetic Oligonucleotide
gggcaugauguugaguuccugggcc

SEQ ID NO: 4906 - DNA, 25 bp, Artificial Sequence
  Synthetic Oligonucleotide
ugagaggugaugaugccagggaggc

SEQ ID NO: 4907 - DNA, 25 bp, Artificial Sequence
  Synthetic Oligonucleotide
guucugaaagcucuggcucuuggcg

SEQ ID NO: 4908 - DNA, 25 bp, Artificial Sequence
  Synthetic Oligonucleotide
uggacggcgagcuugccacugugag

SEQ ID NO: 4909 - DNA, 25 bp, Artificial Sequence
  Synthetic Oligonucleotide
cagggaggcuguuaaacauggcutg

SEQ ID NO: 4910 - DNA, 25 bp, Artificial Sequence
  Synthetic Oligonucleotide
agacaacgucauccccuggcaggct

SEQ ID NO: 4911 - DNA, 25 bp, Artificial Sequence
  Synthetic Oligonucleotide
ugggcaaccgucuggaugaugugcg

SEQ ID NO: 4912 - DNA, 25 bp, Artificial Sequence
  Synthetic Oligonucleotide
uccccuggcaggcuaaagugcugta

SEQ ID NO: 4913 - RNA, 27 nt, Artificial Sequence
  Synthetic Oligonucleotide
ucuuuuuaacaguuaauauauuuccag

SEQ ID NO: 4914 - RNA, 27 nt, Artificial Sequence
  Synthetic Oligonucleotide
acagguuaauaaacaaugagaucauua

SEQ ID NO: 4915 - RNA, 27 nt, Artificial Sequence
  Synthetic Oligonucleotide
guuaauaaacaaugagaucauuaucuu

SEQ ID NO: 4916 - RNA, 27 nt, Artificial Sequence
  Synthetic Oligonucleotide
uucuuuuuaacaguuaauauauuucca

SEQ ID NO: 4917 - RNA, 27 nt, Artificial Sequence
  Synthetic Oligonucleotide
ucucuuugucaaguaauacaugcugaa

SEQ ID NO: 4918 - RNA, 27 nt, Artificial Sequence
  Synthetic Oligonucleotide
uuuuuaacaguuaauauauuuccagga

SEQ ID NO: 4919 - RNA, 27 nt, Artificial Sequence
  Synthetic Oligonucleotide
uuaauaaacaaugagaucauuaucuuu

SEQ ID NO: 4920 - RNA, 27 nt, Artificial Sequence
  Synthetic Oligonucleotide
aaugauaaaguacugguuucaaaauuu

SEQ ID NO: 4921 - RNA, 27 nt, Artificial Sequence
  Synthetic Oligonucleotide
gagaaaaugauaaaguacugguuucaa

SEQ ID NO: 4922 - RNA, 27 nt, Artificial Sequence
  Synthetic Oligonucleotide
cuuuuuaacaguuaauauauuuccagg

SEQ ID NO: 4923 - RNA, 27 nt, Artificial Sequence
  Synthetic Oligonucleotide
ugaaauaaaagggauugcuauuuuguu

SEQ ID NO: 4924 - RNA, 27 nt, Artificial Sequence
  Synthetic Oligonucleotide
cagguuaauaaacaaugagaucauuau

SEQ ID NO: 4925 - RNA, 27 nt, Artificial Sequence
  Synthetic Oligonucleotide
ugagcuuacaauuuaagaaccacuguu

SEQ ID NO: 4926 - RNA, 27 nt, Artificial Sequence
  Synthetic Oligonucleotide
guuaauauauuuccaggaugaaagucc

SEQ ID NO: 4927 - RNA, 27 nt, Artificial Sequence
  Synthetic Oligonucleotide
aguacugauuuagcauguuguucauaa

SEQ ID NO: 4928 - RNA, 27 nt, Artificial Sequence
  Synthetic Oligonucleotide
uaaacaaugagaucauuaucuuuucac

SEQ ID NO: 4929 - RNA, 27 nt, Artificial Sequence
  Synthetic Oligonucleotide
aaaucuacauucaaagaaguaucacca

SEQ ID NO: 4930 - RNA, 27 nt, Artificial Sequence
  Synthetic Oligonucleotide
aacaauuggcaaugaugucagucuucu

SEQ ID NO: 4931 - RNA, 27 nt, Artificial Sequence
  Synthetic Oligonucleotide
uuaauauauuuccaggaugaaagucca

SEQ ID NO: 4932 - RNA, 27 nt, Artificial Sequence
  Synthetic Oligonucleotide
uuaacaguuaauauauuuccaggauga

SEQ ID NO: 4933 - RNA, 27 nt, Artificial Sequence
  Synthetic Oligonucleotide
acaauuggcaaugaugucagucuucuc

SEQ ID NO: 4934 - RNA, 27 nt, Artificial Sequence
  Synthetic Oligonucleotide
ucuacauucaaagaaguaucaccaauu

SEQ ID NO: 4935 - RNA, 27 nt, Artificial Sequence
  Synthetic Oligonucleotide
acagaauacagguuaauaaacaaugag

SEQ ID NO: 4936 - RNA, 27 nt, Artificial Sequence
  Synthetic Oligonucleotide
aacaaugagaucauuaucuuuucaccu

SEQ ID NO: 4937 - RNA, 27 nt, Artificial Sequence
  Synthetic Oligonucleotide
aacaguuaauauauuuccaggaugaaa

SEQ ID NO: 4938 - RNA, 27 nt, Artificial Sequence
  Synthetic Oligonucleotide
augaaauaaaagggauugcuauuuugu

SEQ ID NO: 4939 - RNA, 27 nt, Artificial Sequence
  Synthetic Oligonucleotide
gguuaauaaacaaugagaucauuaucu

SEQ ID NO: 4940 - RNA, 27 nt, Artificial Sequence
  Synthetic Oligonucleotide
acaguuaauauauuuccaggaugaaag

SEQ ID NO: 4941 - RNA, 27 nt, Artificial Sequence
  Synthetic Oligonucleotide
aaagcaaugaaauaaaagggauugcua

SEQ ID NO: 4942 - RNA, 27 nt, Artificial Sequence
  Synthetic Oligonucleotide
aaugaaauaaaagggauugcuauuuug

SEQ ID NO: 4943 - RNA, 27 nt, Artificial Sequence
  Synthetic Oligonucleotide
gucucuuugucaaguaauacaugcuga

SEQ ID NO: 4944 - RNA, 27 nt, Artificial Sequence
  Synthetic Oligonucleotide
uacauucaaagaaguaucaccaauuac

SEQ ID NO: 4945 - RNA, 27 nt, Artificial Sequence
  Synthetic Oligonucleotide
agcauuuucacagguuauugcuauccc

SEQ ID NO: 4946 - RNA, 27 nt, Artificial Sequence
  Synthetic Oligonucleotide
aacagaauacagguuaauaaacaauga

SEQ ID NO: 4947 - RNA, 27 nt, Artificial Sequence
  Synthetic Oligonucleotide
uuucaaaauuuuucauccugaguugug

SEQ ID NO: 4948 - RNA, 27 nt, Artificial Sequence
  Synthetic Oligonucleotide
uaacaguuaauauauuuccaggaugaa

SEQ ID NO: 4949 - RNA, 27 nt, Artificial Sequence
  Synthetic Oligonucleotide
gcauuuucacagguuauugcuauccca

SEQ ID NO: 4950 - RNA, 27 nt, Artificial Sequence
  Synthetic Oligonucleotide
cuacauucaaagaaguaucaccaauua

SEQ ID NO: 4951 - RNA, 27 nt, Artificial Sequence
  Synthetic Oligonucleotide
uaaaguacugguuucaaaauuuuucau

SEQ ID NO: 4952 - RNA, 27 nt, Artificial Sequence
  Synthetic Oligonucleotide
uguuguucauaaucauugauacaaauu

SEQ ID NO: 4953 - RNA, 27 nt, Artificial Sequence
  Synthetic Oligonucleotide
guucauaaucauugauacaaauuagcc

SEQ ID NO: 4954 - RNA, 27 nt, Artificial Sequence
  Synthetic Oligonucleotide
uccuaaaacauuuggauauauucagac

SEQ ID NO: 4955 - RNA, 27 nt, Artificial Sequence
  Synthetic Oligonucleotide
gagcuuacaauuuaagaaccacuguuu

SEQ ID NO: 4956 - RNA, 27 nt, Artificial Sequence
  Synthetic Oligonucleotide
aauacagguuaauaaacaaugagauca

SEQ ID NO: 4957 - RNA, 27 nt, Artificial Sequence
  Synthetic Oligonucleotide
cagaauacagguuaauaaacaaugaga

SEQ ID NO: 4958 - RNA, 27 nt, Artificial Sequence
  Synthetic Oligonucleotide
uugucaaguaauacaugcugaaaaaaa

SEQ ID NO: 4959 - RNA, 27 nt, Artificial Sequence
  Synthetic Oligonucleotide
ucaggagaaaaugauaaaguacugguu

SEQ ID NO: 4960 - RNA, 27 nt, Artificial Sequence
  Synthetic Oligonucleotide
uucucaaaguugugaaucaggcauuac

SEQ ID NO: 4961 - RNA, 27 nt, Artificial Sequence
  Synthetic Oligonucleotide
augauaaaguacugguuucaaaauuuu

SEQ ID NO: 4962 - RNA, 27 nt, Artificial Sequence
  Synthetic Oligonucleotide
aagcaaugaaauaaaagggauugcuau

SEQ ID NO: 4963 - RNA, 27 nt, Artificial Sequence
  Synthetic Oligonucleotide
uucauaaucauugauacaaauuagccg

SEQ ID NO: 4964 - RNA, 27 nt, Artificial Sequence
  Synthetic Oligonucleotide
uuuuaacaguuaauauauuuccaggau

SEQ ID NO: 4965 - RNA, 27 nt, Artificial Sequence
  Synthetic Oligonucleotide
uaauaaacaaugagaucauuaucuuuu

SEQ ID NO: 4966 - RNA, 27 nt, Artificial Sequence
  Synthetic Oligonucleotide
cauccuaaaacauuuggauauauucag

SEQ ID NO: 4967 - RNA, 27 nt, Artificial Sequence
  Synthetic Oligonucleotide
guuguucauaaucauugauacaaauua

SEQ ID NO: 4968 - RNA, 27 nt, Artificial Sequence
  Synthetic Oligonucleotide
uuugcaacaauuggcaaugaugucagu

SEQ ID NO: 4969 - RNA, 27 nt, Artificial Sequence
  Synthetic Oligonucleotide
ugauuuagcauguuguucauaaucauu

SEQ ID NO: 4970 - RNA, 27 nt, Artificial Sequence
  Synthetic Oligonucleotide
caaugaaauaaaagggauugcuauuuu

SEQ ID NO: 4971 - RNA, 27 nt, Artificial Sequence
  Synthetic Oligonucleotide
gagcauuuucacagguuauugcuaucc

SEQ ID NO: 4972 - RNA, 27 nt, Artificial Sequence
  Synthetic Oligonucleotide
uguucauaaucauugauacaaauuagc

SEQ ID NO: 4973 - RNA, 27 nt, Artificial Sequence
  Synthetic Oligonucleotide
ggaaguacugauuuagcauguuguuca

SEQ ID NO: 4974 - RNA, 27 nt, Artificial Sequence
  Synthetic Oligonucleotide
auugaaaagucaaaagcaaugaaauaa

SEQ ID NO: 4975 - RNA, 27 nt, Artificial Sequence
  Synthetic Oligonucleotide
aacacuuugaaccugagcuuacaauuu

SEQ ID NO: 4976 - RNA, 27 nt, Artificial Sequence
  Synthetic Oligonucleotide
uugcaacaauuggcaaugaugucaguc

SEQ ID NO: 4977 - RNA, 27 nt, Artificial Sequence
  Synthetic Oligonucleotide
uacagguuaauaaacaaugagaucauu

SEQ ID NO: 4978 - RNA, 27 nt, Artificial Sequence
  Synthetic Oligonucleotide
acugauuuagcauguuguucauaauca

SEQ ID NO: 4979 - RNA, 27 nt, Artificial Sequence
  Synthetic Oligonucleotide
auauauuuccaggaugaaaguccauuu

SEQ ID NO: 4980 - RNA, 27 nt, Artificial Sequence
  Synthetic Oligonucleotide
uugugaaucaggcauuaccaacacuuu

SEQ ID NO: 4981 - RNA, 27 nt, Artificial Sequence
  Synthetic Oligonucleotide
gcauguuguucauaaucauugauacaa

SEQ ID NO: 4982 - RNA, 27 nt, Artificial Sequence
  Synthetic Oligonucleotide
ucaaaagcaaugaaauaaaagggauug

SEQ ID NO: 4983 - RNA, 27 nt, Artificial Sequence
  Synthetic Oligonucleotide
cauucaaagaaguaucaccaauuaccg

SEQ ID NO: 4984 - RNA, 27 nt, Artificial Sequence
  Synthetic Oligonucleotide
gauuuuuccucaccaaugucuugucga

SEQ ID NO: 4985 - RNA, 27 nt, Artificial Sequence
  Synthetic Oligonucleotide
agcaaugaaauaaaagggauugcuauu

SEQ ID NO: 4986 - RNA, 27 nt, Artificial Sequence
  Synthetic Oligonucleotide
aaaguugugaaucaggcauuaccaaca

SEQ ID NO: 4987 - RNA, 27 nt, Artificial Sequence
  Synthetic Oligonucleotide
caauguuuucuuuuuaacaguuaauau

SEQ ID NO: 4988 - RNA, 27 nt, Artificial Sequence
  Synthetic Oligonucleotide
acugguuucaaaauuuuucauccugag

SEQ ID NO: 4989 - RNA, 27 nt, Artificial Sequence
  Synthetic Oligonucleotide
cauuuucacagguuauugcuaucccag

SEQ ID NO: 4990 - RNA, 27 nt, Artificial Sequence
  Synthetic Oligonucleotide
ugauaaaguacugguuucaaaauuuuu

SEQ ID NO: 4991 - RNA, 27 nt, Artificial Sequence
  Synthetic Oligonucleotide
aaucuacauucaaagaaguaucaccaa

SEQ ID NO: 4992 - RNA, 27 nt, Artificial Sequence
  Synthetic Oligonucleotide
uuagcauguuguucauaaucauugaua

SEQ ID NO: 4993 - RNA, 27 nt, Artificial Sequence
  Synthetic Oligonucleotide
uuaccaacacuuugaaccugagcuuac

SEQ ID NO: 4994 - RNA, 27 nt, Artificial Sequence
  Synthetic Oligonucleotide
uuguucauaaucauugauacaaauuag

SEQ ID NO: 4995 - RNA, 27 nt, Artificial Sequence
  Synthetic Oligonucleotide
cauugaaaagucaaaagcaaugaaaua

SEQ ID NO: 4996 - RNA, 27 nt, Artificial Sequence
  Synthetic Oligonucleotide
auccuaaaacauuuggauauauucaga

SEQ ID NO: 4997 - RNA, 27 nt, Artificial Sequence
  Synthetic Oligonucleotide
cugauuuagcauguuguucauaaucau

SEQ ID NO: 4998 - RNA, 27 nt, Artificial Sequence
  Synthetic Oligonucleotide
auguuuucuuuuuaacaguuaauauau

SEQ ID NO: 4999 - RNA, 27 nt, Artificial Sequence
  Synthetic Oligonucleotide
caaaguugugaaucaggcauuaccaac

SEQ ID NO: 5000 - RNA, 27 nt, Artificial Sequence
  Synthetic Oligonucleotide
aguacugguuucaaaauuuuucauccu

SEQ ID NO: 5001 - RNA, 27 nt, Artificial Sequence
  Synthetic Oligonucleotide
gaaaaugauaaaguacugguuucaaaa

SEQ ID NO: 5002 - RNA, 27 nt, Artificial Sequence
  Synthetic Oligonucleotide
uguaauagucauauauagacuuuggaa

SEQ ID NO: 5003 - RNA, 27 nt, Artificial Sequence
  Synthetic Oligonucleotide
ugguuucaaaauuuuucauccugaguu

SEQ ID NO: 5004 - RNA, 27 nt, Artificial Sequence
  Synthetic Oligonucleotide
acauguaaacagaauacagguuaauaa

SEQ ID NO: 5005 - RNA, 27 nt, Artificial Sequence
  Synthetic Oligonucleotide
cucuuugucaaguaauacaugcugaaa

SEQ ID NO: 5006 - RNA, 27 nt, Artificial Sequence
  Synthetic Oligonucleotide
aaauaauacagaugggaaaauauugug

SEQ ID NO: 5007 - RNA, 27 nt, Artificial Sequence
  Synthetic Oligonucleotide
uuuguauugaaguggggaauuacagac

SEQ ID NO: 5008 - RNA, 27 nt, Artificial Sequence
  Synthetic Oligonucleotide
gugaaucaggcauuaccaacacuuuga

SEQ ID NO: 5009 - RNA, 27 nt, Artificial Sequence
  Synthetic Oligonucleotide
aauuuuacuaaaggauacagcacuuua

SEQ ID NO: 5010 - RNA, 27 nt, Artificial Sequence
  Synthetic Oligonucleotide
aguuaauauauuuccaggaugaaaguc

SEQ ID NO: 5011 - RNA, 27 nt, Artificial Sequence
  Synthetic Oligonucleotide
uuugaaucuguuacgcacaucauccag

SEQ ID NO: 5012 - RNA, 27 nt, Artificial Sequence
  Synthetic Oligonucleotide
accaaugucuugucgaugacuuucaca

SEQ ID NO: 5013 - RNA, 27 nt, Artificial Sequence
  Synthetic Oligonucleotide
cugguuucaaaauuuuucauccugagu

SEQ ID NO: 5014 - RNA, 27 nt, Artificial Sequence
  Synthetic Oligonucleotide
uuucuuuuuaacaguuaauauauuucc

SEQ ID NO: 5015 - RNA, 27 nt, Artificial Sequence
  Synthetic Oligonucleotide
cuuugucaaguaauacaugcugaaaaa

SEQ ID NO: 5016 - RNA, 27 nt, Artificial Sequence
  Synthetic Oligonucleotide
ucuuugucaaguaauacaugcugaaaa

SEQ ID NO: 5017 - RNA, 27 nt, Artificial Sequence
  Synthetic Oligonucleotide
auaauacagaugggaaaauauugugca

SEQ ID NO: 5018 - RNA, 27 nt, Artificial Sequence
  Synthetic Oligonucleotide
aucauuaucuuuucaccuuaguguuug

SEQ ID NO: 5019 - RNA, 27 nt, Artificial Sequence
  Synthetic Oligonucleotide
augucuugucgaugacuuucacauucu

SEQ ID NO: 5020 - RNA, 27 nt, Artificial Sequence
  Synthetic Oligonucleotide
auaaaguacugguuucaaaauuuuuca

SEQ ID NO: 5021 - RNA, 27 nt, Artificial Sequence
  Synthetic Oligonucleotide
uaauauauuuccaggaugaaaguccau

SEQ ID NO: 5022 - RNA, 27 nt, Artificial Sequence
  Synthetic Oligonucleotide
acacuuugaaccugagcuuacaauuua

SEQ ID NO: 5023 - RNA, 27 nt, Artificial Sequence
  Synthetic Oligonucleotide
uuuaacaguuaauauauuuccaggaug

SEQ ID NO: 5024 - RNA, 27 nt, Artificial Sequence
  Synthetic Oligonucleotide
aauguuuucuuuuuaacaguuaauaua

SEQ ID NO: 5025 - RNA, 27 nt, Artificial Sequence
  Synthetic Oligonucleotide
gucaaaagcaaugaaauaaaagggauu

SEQ ID NO: 5026 - RNA, 27 nt, Artificial Sequence
  Synthetic Oligonucleotide
guaacauacauccuaaaacauuuggau

SEQ ID NO: 5027 - RNA, 27 nt, Artificial Sequence
  Synthetic Oligonucleotide
acauuuucaauguuuucuuuuuaacag

SEQ ID NO: 5028 - RNA, 27 nt, Artificial Sequence
  Synthetic Oligonucleotide
ugcaacaauuggcaaugaugucagucu

SEQ ID NO: 5029 - RNA, 27 nt, Artificial Sequence
  Synthetic Oligonucleotide
agaaaaugauaaaguacugguuucaaa

SEQ ID NO: 5030 - RNA, 27 nt, Artificial Sequence
  Synthetic Oligonucleotide
acaauuucuggcagaacaucaauagug

SEQ ID NO: 5031 - RNA, 27 nt, Artificial Sequence
  Synthetic Oligonucleotide
uuuucuuuuuaacaguuaauauauuuc

SEQ ID NO: 5032 - RNA, 27 nt, Artificial Sequence
  Synthetic Oligonucleotide
agucaaaagcaaugaaauaaaagggau

SEQ ID NO: 5033 - RNA, 27 nt, Artificial Sequence
  Synthetic Oligonucleotide
agaauacagguuaauaaacaaugagau

SEQ ID NO: 5034 - RNA, 27 nt, Artificial Sequence
  Synthetic Oligonucleotide
guuugaaucuguuacgcacaucaucca

SEQ ID NO: 5035 - RNA, 27 nt, Artificial Sequence
  Synthetic Oligonucleotide
uauauuuccaggaugaaaguccauuuc

SEQ ID NO: 5036 - RNA, 27 nt, Artificial Sequence
  Synthetic Oligonucleotide
aaaugauaaaguacugguuucaaaauu

SEQ ID NO: 5037 - RNA, 27 nt, Artificial Sequence
  Synthetic Oligonucleotide
uucaaaauuuuucauccugaguugugg

SEQ ID NO: 5038 - RNA, 27 nt, Artificial Sequence
  Synthetic Oligonucleotide
gugucucuuugucaaguaauacaugcu

SEQ ID NO: 5039 - RNA, 27 nt, Artificial Sequence
  Synthetic Oligonucleotide
cacuuugaaccugagcuuacaauuuaa

SEQ ID NO: 5040 - RNA, 27 nt, Artificial Sequence
  Synthetic Oligonucleotide
guaaacagaauacagguuaauaaacaa

SEQ ID NO: 5041 - RNA, 27 nt, Artificial Sequence
  Synthetic Oligonucleotide
ggagaaaaugauaaaguacugguuuca

SEQ ID NO: 5042 - RNA, 27 nt, Artificial Sequence
  Synthetic Oligonucleotide
ugucuugucgaugacuuucacauucug

SEQ ID NO: 5043 - RNA, 27 nt, Artificial Sequence
  Synthetic Oligonucleotide
uagcauguuguucauaaucauugauac

SEQ ID NO: 5044 - RNA, 27 nt, Artificial Sequence
  Synthetic Oligonucleotide
agguuaauaaacaaugagaucauuauc

SEQ ID NO: 5045 - RNA, 27 nt, Artificial Sequence
  Synthetic Oligonucleotide
uuuuaaagacauguaaacagaauacag

SEQ ID NO: 5046 - RNA, 27 nt, Artificial Sequence
  Synthetic Oligonucleotide
aaaaauaauacagaugggaaaauauug

SEQ ID NO: 5047 - RNA, 27 nt, Artificial Sequence
  Synthetic Oligonucleotide
aaacauuuggauauauucagacacuaa

SEQ ID NO: 5048 - RNA, 27 nt, Artificial Sequence
  Synthetic Oligonucleotide
aauaauacagaugggaaaauauugugc

SEQ ID NO: 5049 - RNA, 27 nt, Artificial Sequence
  Synthetic Oligonucleotide
auugcuauuuuguuggaaaagaacgac

SEQ ID NO: 5050 - RNA, 27 nt, Artificial Sequence
  Synthetic Oligonucleotide
cuuugcaacaauuggcaaugaugucag

SEQ ID NO: 5051 - RNA, 27 nt, Artificial Sequence
  Synthetic Oligonucleotide
guugugaaucaggcauuaccaacacuu

SEQ ID NO: 5052 - RNA, 27 nt, Artificial Sequence
  Synthetic Oligonucleotide
caacaauuggcaaugaugucagucuuc

SEQ ID NO: 5053 - RNA, 27 nt, Artificial Sequence
  Synthetic Oligonucleotide
aauaaacaaugagaucauuaucuuuuc

SEQ ID NO: 5054 - RNA, 27 nt, Artificial Sequence
  Synthetic Oligonucleotide
guuucaaaauuuuucauccugaguugu

SEQ ID NO: 5055 - RNA, 27 nt, Artificial Sequence
  Synthetic Oligonucleotide
aucuggaaaaugcugcaauauuaucag

SEQ ID NO: 5056 - RNA, 27 nt, Artificial Sequence
  Synthetic Oligonucleotide
aggagaaaaugauaaaguacugguuuc

SEQ ID NO: 5057 - RNA, 27 nt, Artificial Sequence
  Synthetic Oligonucleotide
aaaauaauacagaugggaaaauauugu

SEQ ID NO: 5058 - RNA, 27 nt, Artificial Sequence
  Synthetic Oligonucleotide
cucaggagaaaaugauaaaguacuggu

SEQ ID NO: 5059 - RNA, 27 nt, Artificial Sequence
  Synthetic Oligonucleotide
ucauauauagacuuuggaaguacugau

SEQ ID NO: 5060 - RNA, 27 nt, Artificial Sequence
  Synthetic Oligonucleotide
ugagaucauuaucuuuucaccuuagug

SEQ ID NO: 5061 - RNA, 27 nt, Artificial Sequence
  Synthetic Oligonucleotide
auuaccaacacuuugaaccugagcuua

SEQ ID NO: 5062 - RNA, 27 nt, Artificial Sequence
  Synthetic Oligonucleotide
uuggcaaugaugucagucuucucagcc

SEQ ID NO: 5063 - RNA, 27 nt, Artificial Sequence
  Synthetic Oligonucleotide
acaaugagaucauuaucuuuucaccuu

SEQ ID NO: 5064 - RNA, 27 nt, Artificial Sequence
  Synthetic Oligonucleotide
gucuugucgaugacuuucacauucugg

SEQ ID NO: 5065 - RNA, 27 nt, Artificial Sequence
  Synthetic Oligonucleotide
ugucucuuugucaaguaauacaugcug

SEQ ID NO: 5066 - RNA, 27 nt, Artificial Sequence
  Synthetic Oligonucleotide
acccauugaaaagucaaaagcaaugaa

SEQ ID NO: 5067 - RNA, 27 nt, Artificial Sequence
  Synthetic Oligonucleotide
augagaucauuaucuuuucaccuuagu

SEQ ID NO: 5068 - RNA, 27 nt, Artificial Sequence
  Synthetic Oligonucleotide
uaccuucucaaaguugugaaucaggca

SEQ ID NO: 5069 - RNA, 27 nt, Artificial Sequence
  Synthetic Oligonucleotide
aaaagcaaugaaauaaaagggauugcu

SEQ ID NO: 5070 - RNA, 27 nt, Artificial Sequence
  Synthetic Oligonucleotide
uugaaaagucaaaagcaaugaaauaaa

SEQ ID NO: 5071 - RNA, 27 nt, Artificial Sequence
  Synthetic Oligonucleotide
uguauugaaguggggaauuacagacug

SEQ ID NO: 5072 - RNA, 27 nt, Artificial Sequence
  Synthetic Oligonucleotide
gaaaucuacauucaaagaaguaucacc

SEQ ID NO: 5073 - RNA, 27 nt, Artificial Sequence
  Synthetic Oligonucleotide
uuuagcauguuguucauaaucauugau

SEQ ID NO: 5074 - RNA, 27 nt, Artificial Sequence
  Synthetic Oligonucleotide
ccaauuuuacuaaaggauacagcacuu

SEQ ID NO: 5075 - RNA, 27 nt, Artificial Sequence
  Synthetic Oligonucleotide
ugcuauuuuguuggaaaagaacgacac

SEQ ID NO: 5076 - RNA, 27 nt, Artificial Sequence
  Synthetic Oligonucleotide
gaaauaaaagggauugcuauuuuguug

SEQ ID NO: 5077 - RNA, 27 nt, Artificial Sequence
  Synthetic Oligonucleotide
uuguauugaaguggggaauuacagacu

SEQ ID NO: 5078 - RNA, 27 nt, Artificial Sequence
  Synthetic Oligonucleotide
ucaccaaugucuugucgaugacuuuca

SEQ ID NO: 5079 - RNA, 27 nt, Artificial Sequence
  Synthetic Oligonucleotide
uguaaacagaauacagguuaauaaaca

SEQ ID NO: 5080 - RNA, 27 nt, Artificial Sequence
  Synthetic Oligonucleotide
uuuauuucucucuaagaaguaacauac

SEQ ID NO: 5081 - RNA, 27 nt, Artificial Sequence
  Synthetic Oligonucleotide
uaacauacauccuaaaacauuuggaua

SEQ ID NO: 5082 - RNA, 27 nt, Artificial Sequence
  Synthetic Oligonucleotide
gaaccugagcuuacaauuuaagaacca

SEQ ID NO: 5083 - RNA, 27 nt, Artificial Sequence
  Synthetic Oligonucleotide
aauaaaagggauugcuauuuuguugga

SEQ ID NO: 5084 - RNA, 27 nt, Artificial Sequence
  Synthetic Oligonucleotide
gaaguacugauuuagcauguuguucau

SEQ ID NO: 5085 - RNA, 27 nt, Artificial Sequence
  Synthetic Oligonucleotide
ucauuaucuuuucaccuuaguguuugc

SEQ ID NO: 5086 - RNA, 27 nt, Artificial Sequence
  Synthetic Oligonucleotide
ucauaaucauugauacaaauuagccgg

SEQ ID NO: 5087 - RNA, 27 nt, Artificial Sequence
  Synthetic Oligonucleotide
gcaaugaaauaaaagggauugcuauuu

SEQ ID NO: 5088 - RNA, 27 nt, Artificial Sequence
  Synthetic Oligonucleotide
aauauauuuccaggaugaaaguccauu

SEQ ID NO: 5089 - RNA, 27 nt, Artificial Sequence
  Synthetic Oligonucleotide
uggaaaaugcugcaauauuaucagcca

SEQ ID NO: 5090 - RNA, 27 nt, Artificial Sequence
  Synthetic Oligonucleotide
aaauaaaagggauugcuauuuuguugg

SEQ ID NO: 5091 - RNA, 27 nt, Artificial Sequence
  Synthetic Oligonucleotide
agaaguaacauacauccuaaaacauuu

SEQ ID NO: 5092 - RNA, 27 nt, Artificial Sequence
  Synthetic Oligonucleotide
aacauuuggauauauucagacacuaaa

SEQ ID NO: 5093 - RNA, 27 nt, Artificial Sequence
  Synthetic Oligonucleotide
aagucaaaagcaaugaaauaaaaggga

SEQ ID NO: 5094 - RNA, 27 nt, Artificial Sequence
  Synthetic Oligonucleotide
cuaaaacauuuggauauauucagacac

SEQ ID NO: 5095 - RNA, 27 nt, Artificial Sequence
  Synthetic Oligonucleotide
ucuugucgaugacuuucacauucuggc

SEQ ID NO: 5096 - RNA, 27 nt, Artificial Sequence
  Synthetic Oligonucleotide
gauaaaguacugguuucaaaauuuuuc

SEQ ID NO: 5097 - RNA, 27 nt, Artificial Sequence
  Synthetic Oligonucleotide
uuugucaaguaauacaugcugaaaaaa

SEQ ID NO: 5098 - RNA, 27 nt, Artificial Sequence
  Synthetic Oligonucleotide
ccuaaaacauuuggauauauucagaca

SEQ ID NO: 5099 - RNA, 27 nt, Artificial Sequence
  Synthetic Oligonucleotide
aaguacugguuucaaaauuuuucaucc

SEQ ID NO: 5100 - RNA, 27 nt, Artificial Sequence
  Synthetic Oligonucleotide
uacugguuucaaaauuuuucauccuga

SEQ ID NO: 5101 - RNA, 27 nt, Artificial Sequence
  Synthetic Oligonucleotide
cuguaauagucauauauagacuuugga

SEQ ID NO: 5102 - RNA, 27 nt, Artificial Sequence
  Synthetic Oligonucleotide
aaaacauuuggauauauucagacacua

SEQ ID NO: 5103 - RNA, 27 nt, Artificial Sequence
  Synthetic Oligonucleotide
gauuuagcauguuguucauaaucauug

SEQ ID NO: 5104 - RNA, 27 nt, Artificial Sequence
  Synthetic Oligonucleotide
cacauuuucaauguuuucuuuuuaaca

SEQ ID NO: 5105 - RNA, 27 nt, Artificial Sequence
  Synthetic Oligonucleotide
aaacaaugagaucauuaucuuuucacc

SEQ ID NO: 5106 - RNA, 27 nt, Artificial Sequence
  Synthetic Oligonucleotide
uugcuauuuuguuggaaaagaacgaca

SEQ ID NO: 5107 - RNA, 27 nt, Artificial Sequence
  Synthetic Oligonucleotide
uccaauuuuacuaaaggauacagcacu

SEQ ID NO: 5108 - RNA, 27 nt, Artificial Sequence
  Synthetic Oligonucleotide
caauuuuacuaaaggauacagcacuuu

SEQ ID NO: 5109 - RNA, 27 nt, Artificial Sequence
  Synthetic Oligonucleotide
accuguaauagucauauauagacuuug

SEQ ID NO: 5110 - RNA, 27 nt, Artificial Sequence
  Synthetic Oligonucleotide
ugaaucaggcauuaccaacacuuugaa

SEQ ID NO: 5111 - RNA, 27 nt, Artificial Sequence
  Synthetic Oligonucleotide
auucaaagaaguaucaccaauuaccgc

SEQ ID NO: 5112 - RNA, 27 nt, Artificial Sequence
  Synthetic Oligonucleotide
aguaacauacauccuaaaacauuugga

SEQ ID NO: 5113 - RNA, 27 nt, Artificial Sequence
  Synthetic Oligonucleotide
uggaaaucuacauucaaagaaguauca

SEQ ID NO: 5114 - RNA, 27 nt, Artificial Sequence
  Synthetic Oligonucleotide
auacagguuaauaaacaaugagaucau

SEQ ID NO: 5115 - RNA, 27 nt, Artificial Sequence
  Synthetic Oligonucleotide
aaguaacauacauccuaaaacauuugg

SEQ ID NO: 5116 - RNA, 27 nt, Artificial Sequence
  Synthetic Oligonucleotide
aauuggcaaugaugucagucuucucag

SEQ ID NO: 5117 - RNA, 27 nt, Artificial Sequence
  Synthetic Oligonucleotide
uuuucaauguuuucuuuuuaacaguua

SEQ ID NO: 5118 - RNA, 27 nt, Artificial Sequence
  Synthetic Oligonucleotide
cacaauuucuggcagaacaucaauagu

SEQ ID NO: 5119 - RNA, 27 nt, Artificial Sequence
  Synthetic Oligonucleotide
agcuuacaauuuaagaaccacuguuuu

SEQ ID NO: 5120 - RNA, 27 nt, Artificial Sequence
  Synthetic Oligonucleotide
caguuaauauauuuccaggaugaaagu

SEQ ID NO: 5121 - RNA, 27 nt, Artificial Sequence
  Synthetic Oligonucleotide
aaugcugcaauauuaucagccaaaguu

SEQ ID NO: 5122 - RNA, 27 nt, Artificial Sequence
  Synthetic Oligonucleotide
aaaauuuuccucaggagaaaaugauaa

SEQ ID NO: 5123 - RNA, 27 nt, Artificial Sequence
  Synthetic Oligonucleotide
auauauagacuuuggaaguacugauuu

SEQ ID NO: 5124 - RNA, 27 nt, Artificial Sequence
  Synthetic Oligonucleotide
aaaagucaaaagcaaugaaauaaaagg

SEQ ID NO: 5125 - RNA, 27 nt, Artificial Sequence
  Synthetic Oligonucleotide
auauuuccaggaugaaaguccauuucu

SEQ ID NO: 5126 - RNA, 27 nt, Artificial Sequence
  Synthetic Oligonucleotide
aauagucauauauagacuuuggaagua

SEQ ID NO: 5127 - RNA, 27 nt, Artificial Sequence
  Synthetic Oligonucleotide
uauuuuguuggaaaagaacgacacccu

SEQ ID NO: 5128 - RNA, 27 nt, Artificial Sequence
  Synthetic Oligonucleotide
caaugagaucauuaucuuuucaccuua

SEQ ID NO: 5129 - RNA, 27 nt, Artificial Sequence
  Synthetic Oligonucleotide
cacagugucucuuugucaaguaauaca

SEQ ID NO: 5130 - RNA, 27 nt, Artificial Sequence
  Synthetic Oligonucleotide
gcaguuugaaucuguuacgcacaucau

SEQ ID NO: 5131 - RNA, 27 nt, Artificial Sequence
  Synthetic Oligonucleotide
aaaguacugguuucaaaauuuuucauc

SEQ ID NO: 5132 - RNA, 27 nt, Artificial Sequence
  Synthetic Oligonucleotide
ucuggaaaaugcugcaauauuaucagc

SEQ ID NO: 5133 - RNA, 27 nt, Artificial Sequence
  Synthetic Oligonucleotide
uugaaucuguuacgcacaucauccaga

SEQ ID NO: 5134 - RNA, 27 nt, Artificial Sequence
  Synthetic Oligonucleotide
auuuuuccucaccaaugucuugucgau

SEQ ID NO: 5135 - RNA, 27 nt, Artificial Sequence
  Synthetic Oligonucleotide
ugugaaucaggcauuaccaacacuuug

SEQ ID NO: 5136 - RNA, 27 nt, Artificial Sequence
  Synthetic Oligonucleotide
aaugaugucagucuucucagccauuug

SEQ ID NO: 5137 - RNA, 27 nt, Artificial Sequence
  Synthetic Oligonucleotide
caauauuaucagccaaaguuucuucau

SEQ ID NO: 5138 - RNA, 27 nt, Artificial Sequence
  Synthetic Oligonucleotide
auaaacaaugagaucauuaucuuuuca

SEQ ID NO: 5139 - RNA, 27 nt, Artificial Sequence
  Synthetic Oligonucleotide
cauguuguucauaaucauugauacaaa

SEQ ID NO: 5140 - RNA, 27 nt, Artificial Sequence
  Synthetic Oligonucleotide
gcaacaauuggcaaugaugucagucuu

SEQ ID NO: 5141 - RNA, 27 nt, Artificial Sequence
  Synthetic Oligonucleotide
uuaucuuuucaccuuaguguuugcuac

SEQ ID NO: 5142 - RNA, 27 nt, Artificial Sequence
  Synthetic Oligonucleotide
ugucgaugacuuucacauucuggcacc

SEQ ID NO: 5143 - RNA, 27 nt, Artificial Sequence
  Synthetic Oligonucleotide
auuucuggcagaacaucaauaguggcu

SEQ ID NO: 5144 - RNA, 27 nt, Artificial Sequence
  Synthetic Oligonucleotide
aaaaugauaaaguacugguuucaaaau

SEQ ID NO: 5145 - RNA, 27 nt, Artificial Sequence
  Synthetic Oligonucleotide
cuuuguauugaaguggggaauuacaga

SEQ ID NO: 5146 - RNA, 27 nt, Artificial Sequence
  Synthetic Oligonucleotide
ggagcauuuucacagguuauugcuauc

SEQ ID NO: 5147 - RNA, 27 nt, Artificial Sequence
  Synthetic Oligonucleotide
uuucaauguuuucuuuuuaacaguuaa

SEQ ID NO: 5148 - RNA, 27 nt, Artificial Sequence
  Synthetic Oligonucleotide
ucaaaauuuuucauccugaguuguggc

SEQ ID NO: 5149 - RNA, 27 nt, Artificial Sequence
  Synthetic Oligonucleotide
caggcauuaccaacacuuugaaccuga

SEQ ID NO: 5150 - RNA, 27 nt, Artificial Sequence
  Synthetic Oligonucleotide
aagacauguaaacagaauacagguuaa

SEQ ID NO: 5151 - RNA, 27 nt, Artificial Sequence
  Synthetic Oligonucleotide
uauauucagacacuaaagaugugauug

SEQ ID NO: 5152 - RNA, 27 nt, Artificial Sequence
  Synthetic Oligonucleotide
accaacacuuugaaccugagcuuacaa

SEQ ID NO: 5153 - RNA, 27 nt, Artificial Sequence
  Synthetic Oligonucleotide
ugugauuggaaaucuacauucaaagaa

SEQ ID NO: 5154 - RNA, 27 nt, Artificial Sequence
  Synthetic Oligonucleotide
gacagaucuguuucagcaacauuccgg

SEQ ID NO: 5155 - RNA, 27 nt, Artificial Sequence
  Synthetic Oligonucleotide
uucaauguuuucuuuuuaacaguuaau

SEQ ID NO: 5156 - RNA, 27 nt, Artificial Sequence
  Synthetic Oligonucleotide
guuuucuuuuuaacaguuaauauauuu

SEQ ID NO: 5157 - RNA, 27 nt, Artificial Sequence
  Synthetic Oligonucleotide
gaaguaacauacauccuaaaacauuug

SEQ ID NO: 5158 - RNA, 27 nt, Artificial Sequence
  Synthetic Oligonucleotide
auguuguucauaaucauugauacaaau

SEQ ID NO: 5159 - RNA, 27 nt, Artificial Sequence
  Synthetic Oligonucleotide
uuacaauuuaagaaccacuguuuuaaa

SEQ ID NO: 5160 - RNA, 27 nt, Artificial Sequence
  Synthetic Oligonucleotide
ugcaauauuaucagccaaaguuucuuc

SEQ ID NO: 5161 - RNA, 27 nt, Artificial Sequence
  Synthetic Oligonucleotide
aaaauauugugcacugucagaucuugg

SEQ ID NO: 5162 - RNA, 27 nt, Artificial Sequence
  Synthetic Oligonucleotide
aaugagaucauuaucuuuucaccuuag

SEQ ID NO: 5163 - RNA, 27 nt, Artificial Sequence
  Synthetic Oligonucleotide
uuccaucuggaaaaugcugcaauauua

SEQ ID NO: 5164 - RNA, 27 nt, Artificial Sequence
  Synthetic Oligonucleotide
uaucuuuucaccuuaguguuugcuacc

SEQ ID NO: 5165 - RNA, 27 nt, Artificial Sequence
  Synthetic Oligonucleotide
ucaaaguugugaaucaggcauuaccaa

SEQ ID NO: 5166 - RNA, 27 nt, Artificial Sequence
  Synthetic Oligonucleotide
caaugucuugucgaugacuuucacauu

SEQ ID NO: 5167 - RNA, 27 nt, Artificial Sequence
  Synthetic Oligonucleotide
cuuacaauuuaagaaccacuguuuuaa

SEQ ID NO: 5168 - RNA, 27 nt, Artificial Sequence
  Synthetic Oligonucleotide
uuuaaagacauguaaacagaauacagg

SEQ ID NO: 5169 - RNA, 27 nt, Artificial Sequence
  Synthetic Oligonucleotide
caauuggcaaugaugucagucuucuca

SEQ ID NO: 5170 - RNA, 27 nt, Artificial Sequence
  Synthetic Oligonucleotide
cuuugaaccugagcuuacaauuuaaga

SEQ ID NO: 5171 - RNA, 27 nt, Artificial Sequence
  Synthetic Oligonucleotide
auuaucuuuucaccuuaguguuugcua

SEQ ID NO: 5172 - RNA, 27 nt, Artificial Sequence
  Synthetic Oligonucleotide
aggcauuaccaacacuuugaaccugag

SEQ ID NO: 5173 - RNA, 27 nt, Artificial Sequence
  Synthetic Oligonucleotide
aggauuuuuccucaccaaugucuuguc

SEQ ID NO: 5174 - RNA, 27 nt, Artificial Sequence
  Synthetic Oligonucleotide
aucuuuucaccuuaguguuugcuaccu

SEQ ID NO: 5175 - RNA, 27 nt, Artificial Sequence
  Synthetic Oligonucleotide
gcuuacaauuuaagaaccacuguuuua

SEQ ID NO: 5176 - RNA, 27 nt, Artificial Sequence
  Synthetic Oligonucleotide
gaaucaggcauuaccaacacuuugaac

SEQ ID NO: 5177 - RNA, 27 nt, Artificial Sequence
  Synthetic Oligonucleotide
gacauguaaacagaauacagguuaaua

SEQ ID NO: 5178 - RNA, 27 nt, Artificial Sequence
  Synthetic Oligonucleotide
aaguugugaaucaggcauuaccaacac

SEQ ID NO: 5179 - RNA, 27 nt, Artificial Sequence
  Synthetic Oligonucleotide
gucauauauagacuuuggaaguacuga

SEQ ID NO: 5180 - RNA, 27 nt, Artificial Sequence
  Synthetic Oligonucleotide
agucauauauagacuuuggaaguacug

SEQ ID NO: 5181 - RNA, 27 nt, Artificial Sequence
  Synthetic Oligonucleotide
auuuagcauguuguucauaaucauuga

SEQ ID NO: 5182 - RNA, 27 nt, Artificial Sequence
  Synthetic Oligonucleotide
uuuaguaucucgaggacaucuugaaca

SEQ ID NO: 5183 - RNA, 27 nt, Artificial Sequence
  Synthetic Oligonucleotide
uacaauuuaagaaccacuguuuuaaag

SEQ ID NO: 5184 - RNA, 27 nt, Artificial Sequence
  Synthetic Oligonucleotide
gaauacagguuaauaaacaaugagauc

SEQ ID NO: 5185 - RNA, 27 nt, Artificial Sequence
  Synthetic Oligonucleotide
aguugugaaucaggcauuaccaacacu

SEQ ID NO: 5186 - RNA, 27 nt, Artificial Sequence
  Synthetic Oligonucleotide
uuuggaaguacugauuuagcauguugu

SEQ ID NO: 5187 - RNA, 27 nt, Artificial Sequence
  Synthetic Oligonucleotide
uuugaaccugagcuuacaauuuaagaa

SEQ ID NO: 5188 - RNA, 27 nt, Artificial Sequence
  Synthetic Oligonucleotide
uguagauauacaguugcagccaacgaa

SEQ ID NO: 5189 - RNA, 27 nt, Artificial Sequence
  Synthetic Oligonucleotide
uauauagacuuuggaaguacugauuua

SEQ ID NO: 5190 - RNA, 27 nt, Artificial Sequence
  Synthetic Oligonucleotide
aaggauuuuuccucaccaaugucuugu

SEQ ID NO: 5191 - RNA, 27 nt, Artificial Sequence
  Synthetic Oligonucleotide
agugucucuuugucaaguaauacaugc

SEQ ID NO: 5192 - RNA, 27 nt, Artificial Sequence
  Synthetic Oligonucleotide
ggaaaucuacauucaaagaaguaucac

SEQ ID NO: 5193 - RNA, 27 nt, Artificial Sequence
  Synthetic Oligonucleotide
gaaaauauugugcacugucagaucuug

SEQ ID NO: 5194 - RNA, 27 nt, Artificial Sequence
  Synthetic Oligonucleotide
uuggauauauucagacacuaaagaugu

SEQ ID NO: 5195 - RNA, 27 nt, Artificial Sequence
  Synthetic Oligonucleotide
cauuaucuuuucaccuuaguguuugcu

SEQ ID NO: 5196 - RNA, 27 nt, Artificial Sequence
  Synthetic Oligonucleotide
gggagcauuuucacagguuauugcuau

SEQ ID NO: 5197 - RNA, 27 nt, Artificial Sequence
  Synthetic Oligonucleotide
uguuuucuuuuuaacaguuaauauauu

SEQ ID NO: 5198 - RNA, 27 nt, Artificial Sequence
  Synthetic Oligonucleotide
ggcaguuugaaucuguuacgcacauca

SEQ ID NO: 5199 - RNA, 27 nt, Artificial Sequence
  Synthetic Oligonucleotide
cauauauagacuuuggaaguacugauu

SEQ ID NO: 5200 - RNA, 27 nt, Artificial Sequence
  Synthetic Oligonucleotide
acauucaaagaaguaucaccaauuacc

SEQ ID NO: 5201 - RNA, 27 nt, Artificial Sequence
  Synthetic Oligonucleotide
auaaaagggauugcuauuuuguuggaa

SEQ ID NO: 5202 - RNA, 27 nt, Artificial Sequence
  Synthetic Oligonucleotide
uaccaacacuuugaaccugagcuuaca

SEQ ID NO: 5203 - RNA, 27 nt, Artificial Sequence
  Synthetic Oligonucleotide
augggaaaauauugugcacugucagau

SEQ ID NO: 5204 - RNA, 27 nt, Artificial Sequence
  Synthetic Oligonucleotide
acagcuuccaucuggaaaaugcugcaa

SEQ ID NO: 5205 - RNA, 27 nt, Artificial Sequence
  Synthetic Oligonucleotide
aaccugagcuuacaauuuaagaaccac

SEQ ID NO: 5206 - RNA, 27 nt, Artificial Sequence
  Synthetic Oligonucleotide
auauuaucagccaaaguuucuucauca

SEQ ID NO: 5207 - RNA, 27 nt, Artificial Sequence
  Synthetic Oligonucleotide
gaucauuaucuuuucaccuuaguguuu

SEQ ID NO: 5208 - RNA, 27 nt, Artificial Sequence
  Synthetic Oligonucleotide
uaaacagaauacagguuaauaaacaau

SEQ ID NO: 5209 - RNA, 27 nt, Artificial Sequence
  Synthetic Oligonucleotide
caaaauuuuucauccugaguuguggcg

SEQ ID NO: 5210 - RNA, 27 nt, Artificial Sequence
  Synthetic Oligonucleotide
gcugcaauauuaucagccaaaguuucu

SEQ ID NO: 5211 - RNA, 27 nt, Artificial Sequence
  Synthetic Oligonucleotide
uaauacagaugggaaaauauugugcac

SEQ ID NO: 5212 - RNA, 27 nt, Artificial Sequence
  Synthetic Oligonucleotide
caccaaugucuugucgaugacuuucac

SEQ ID NO: 5213 - RNA, 27 nt, Artificial Sequence
  Synthetic Oligonucleotide
uacugauuuagcauguuguucauaauc

SEQ ID NO: 5214 - RNA, 27 nt, Artificial Sequence
  Synthetic Oligonucleotide
uuaaagacauguaaacagaauacaggu

SEQ ID NO: 5215 - RNA, 27 nt, Artificial Sequence
  Synthetic Oligonucleotide
caucuggaaaaugcugcaauauuauca

SEQ ID NO: 5216 - RNA, 27 nt, Artificial Sequence
  Synthetic Oligonucleotide
aaaaaaauaauacagaugggaaaauau

SEQ ID NO: 5217 - RNA, 27 nt, Artificial Sequence
  Synthetic Oligonucleotide
uuauuucucucuaagaaguaacauaca

SEQ ID NO: 5218 - RNA, 27 nt, Artificial Sequence
  Synthetic Oligonucleotide
uuuuccucaccaaugucuugucgauga

SEQ ID NO: 5219 - RNA, 27 nt, Artificial Sequence
  Synthetic Oligonucleotide
gcauuaccaacacuuugaaccugagcu

SEQ ID NO: 5220 - RNA, 27 nt, Artificial Sequence
  Synthetic Oligonucleotide
acagugucucuuugucaaguaauacau

SEQ ID NO: 5221 - RNA, 27 nt, Artificial Sequence
  Synthetic Oligonucleotide
cagugucucuuugucaaguaauacaug

SEQ ID NO: 5222 - RNA, 27 nt, Artificial Sequence
  Synthetic Oligonucleotide
gcuauuuuguuggaaaagaacgacacc

SEQ ID NO: 5223 - RNA, 27 nt, Artificial Sequence
  Synthetic Oligonucleotide
ccuguaauagucauauauagacuuugg

SEQ ID NO: 5224 - RNA, 27 nt, Artificial Sequence
  Synthetic Oligonucleotide
ucuuuucaccuuaguguuugcuaccuc

SEQ ID NO: 5225 - RNA, 27 nt, Artificial Sequence
  Synthetic Oligonucleotide
augucagucuucucagccauuugauau

SEQ ID NO: 5226 - RNA, 27 nt, Artificial Sequence
  Synthetic Oligonucleotide
caggagaaaaugauaaaguacugguuu

SEQ ID NO: 5227 - RNA, 27 nt, Artificial Sequence
  Synthetic Oligonucleotide
ucucaaaguugugaaucaggcauuacc

SEQ ID NO: 5228 - RNA, 27 nt, Artificial Sequence
  Synthetic Oligonucleotide
caauuucuggcagaacaucaauagugg

SEQ ID NO: 5229 - RNA, 27 nt, Artificial Sequence
  Synthetic Oligonucleotide
auguaaacagaauacagguuaauaaac

SEQ ID NO: 5230 - RNA, 27 nt, Artificial Sequence
  Synthetic Oligonucleotide
ccacaauuucuggcagaacaucaauag

SEQ ID NO: 5231 - RNA, 27 nt, Artificial Sequence
  Synthetic Oligonucleotide
guacugguuucaaaauuuuucauccug

SEQ ID NO: 5232 - RNA, 27 nt, Artificial Sequence
  Synthetic Oligonucleotide
caaaauuuuccucaggagaaaaugaua

SEQ ID NO: 5233 - RNA, 27 nt, Artificial Sequence
  Synthetic Oligonucleotide
cucaaaguugugaaucaggcauuacca

SEQ ID NO: 5234 - RNA, 27 nt, Artificial Sequence
  Synthetic Oligonucleotide
uaaagacauguaaacagaauacagguu

SEQ ID NO: 5235 - RNA, 27 nt, Artificial Sequence
  Synthetic Oligonucleotide
uccucaccaaugucuugucgaugacuu

SEQ ID NO: 5236 - RNA, 27 nt, Artificial Sequence
  Synthetic Oligonucleotide
gcaauauuaucagccaaaguuucuuca

SEQ ID NO: 5237 - RNA, 27 nt, Artificial Sequence
  Synthetic Oligonucleotide
cugagcuuacaauuuaagaaccacugu

SEQ ID NO: 5238 - RNA, 27 nt, Artificial Sequence
  Synthetic Oligonucleotide
auacauccuaaaacauuuggauauauu

SEQ ID NO: 5239 - RNA, 27 nt, Artificial Sequence
  Synthetic Oligonucleotide
aaaggauuuuuccucaccaaugucuug

SEQ ID NO: 5240 - RNA, 27 nt, Artificial Sequence
  Synthetic Oligonucleotide
gaugggaaaauauugugcacugucaga

SEQ ID NO: 5241 - RNA, 27 nt, Artificial Sequence
  Synthetic Oligonucleotide
uugucgaugacuuucacauucuggcac

SEQ ID NO: 5242 - RNA, 27 nt, Artificial Sequence
  Synthetic Oligonucleotide
aaagaugugauuggaaaucuacauuca

SEQ ID NO: 5243 - RNA, 27 nt, Artificial Sequence
  Synthetic Oligonucleotide
cauuuucaauguuuucuuuuuaacagu

SEQ ID NO: 5244 - RNA, 27 nt, Artificial Sequence
  Synthetic Oligonucleotide
aaguacugauuuagcauguuguucaua

SEQ ID NO: 5245 - RNA, 27 nt, Artificial Sequence
  Synthetic Oligonucleotide
agcauguuguucauaaucauugauaca

SEQ ID NO: 5246 - RNA, 27 nt, Artificial Sequence
  Synthetic Oligonucleotide
uguuuuaaagacauguaaacagaauac

SEQ ID NO: 5247 - RNA, 27 nt, Artificial Sequence
  Synthetic Oligonucleotide
gguuucaaaauuuuucauccugaguug

SEQ ID NO: 5248 - RNA, 27 nt, Artificial Sequence
  Synthetic Oligonucleotide
aacauacauccuaaaacauuuggauau

SEQ ID NO: 5249 - RNA, 27 nt, Artificial Sequence
  Synthetic Oligonucleotide
uucaaagaaguaucaccaauuaccgcc

SEQ ID NO: 5250 - RNA, 27 nt, Artificial Sequence
  Synthetic Oligonucleotide
aauauuaucagccaaaguuucuucauc

SEQ ID NO: 5251 - RNA, 27 nt, Artificial Sequence
  Synthetic Oligonucleotide
cccauugaaaagucaaaagcaaugaaa

SEQ ID NO: 5252 - RNA, 27 nt, Artificial Sequence
  Synthetic Oligonucleotide
uaaaacauuuggauauauucagacacu

SEQ ID NO: 5253 - RNA, 27 nt, Artificial Sequence
  Synthetic Oligonucleotide
aaacagaauacagguuaauaaacaaug

SEQ ID NO: 5254 - RNA, 27 nt, Artificial Sequence
  Synthetic Oligonucleotide
cauacauccuaaaacauuuggauauau

SEQ ID NO: 5255 - RNA, 27 nt, Artificial Sequence
  Synthetic Oligonucleotide
acagaugggaaaauauugugcacuguc

SEQ ID NO: 5256 - RNA, 27 nt, Artificial Sequence
  Synthetic Oligonucleotide
aaagacauguaaacagaauacagguua

SEQ ID NO: 5257 - RNA, 27 nt, Artificial Sequence
  Synthetic Oligonucleotide
cuucucaaaguugugaaucaggcauua

SEQ ID NO: 5258 - RNA, 27 nt, Artificial Sequence
  Synthetic Oligonucleotide
uccacaauuucuggcagaacaucaaua

SEQ ID NO: 5259 - RNA, 27 nt, Artificial Sequence
  Synthetic Oligonucleotide
aagaugugauuggaaaucuacauucaa

SEQ ID NO: 5260 - RNA, 27 nt, Artificial Sequence
  Synthetic Oligonucleotide
aaagucaaaagcaaugaaauaaaaggg

SEQ ID NO: 5261 - RNA, 27 nt, Artificial Sequence
  Synthetic Oligonucleotide
cuugucgaugacuuucacauucuggca

SEQ ID NO: 5262 - RNA, 27 nt, Artificial Sequence
  Synthetic Oligonucleotide
aaugucuugucgaugacuuucacauuc

SEQ ID NO: 5263 - RNA, 27 nt, Artificial Sequence
  Synthetic Oligonucleotide
aguuugaaucuguuacgcacaucaucc

SEQ ID NO: 5264 - RNA, 27 nt, Artificial Sequence
  Synthetic Oligonucleotide
cauuaccaacacuuugaaccugagcuu

SEQ ID NO: 5265 - RNA, 27 nt, Artificial Sequence
  Synthetic Oligonucleotide
cuguuuuaaagacauguaaacagaaua

SEQ ID NO: 5266 - RNA, 27 nt, Artificial Sequence
  Synthetic Oligonucleotide
ggauuuuuccucaccaaugucuugucg

SEQ ID NO: 5267 - RNA, 27 nt, Artificial Sequence
  Synthetic Oligonucleotide
uaguguuugcuaccuccaauuuuacua

SEQ ID NO: 5268 - RNA, 27 nt, Artificial Sequence
  Synthetic Oligonucleotide
uagucauauauagacuuuggaaguacu

SEQ ID NO: 5269 - RNA, 27 nt, Artificial Sequence
  Synthetic Oligonucleotide
uaaagaugugauuggaaaucuacauuc

SEQ ID NO: 5270 - RNA, 27 nt, Artificial Sequence
  Synthetic Oligonucleotide
aaauauugugcacugucagaucuugga

SEQ ID NO: 5271 - RNA, 27 nt, Artificial Sequence
  Synthetic Oligonucleotide
auuggaaaucuacauucaaagaaguau

SEQ ID NO: 5272 - RNA, 27 nt, Artificial Sequence
  Synthetic Oligonucleotide
cuggaaaaugcugcaauauuaucagcc

SEQ ID NO: 5273 - RNA, 27 nt, Artificial Sequence
  Synthetic Oligonucleotide
uagacuuuggaaguacugauuuagcau

SEQ ID NO: 5274 - RNA, 27 nt, Artificial Sequence
  Synthetic Oligonucleotide
uucccaaaaaugcuuuauuucucucua

SEQ ID NO: 5275 - RNA, 27 nt, Artificial Sequence
  Synthetic Oligonucleotide
uacauccuaaaacauuuggauauauuc

SEQ ID NO: 5276 - RNA, 27 nt, Artificial Sequence
  Synthetic Oligonucleotide
ugaaaagucaaaagcaaugaaauaaaa

SEQ ID NO: 5277 - RNA, 27 nt, Artificial Sequence
  Synthetic Oligonucleotide
uacagaugggaaaauauugugcacugu

SEQ ID NO: 5278 - RNA, 27 nt, Artificial Sequence
  Synthetic Oligonucleotide
gauauauucagacacuaaagaugugau

SEQ ID NO: 5279 - RNA, 27 nt, Artificial Sequence
  Synthetic Oligonucleotide
uauuucucucuaagaaguaacauacau

SEQ ID NO: 5280 - RNA, 27 nt, Artificial Sequence
  Synthetic Oligonucleotide
guccauuucuuucuaaaagguuccuag

SEQ ID NO: 5281 - RNA, 27 nt, Artificial Sequence
  Synthetic Oligonucleotide
uuaguaucucgaggacaucuugaacac

SEQ ID NO: 5282 - RNA, 27 nt, Artificial Sequence
  Synthetic Oligonucleotide
cauaaucauugauacaaauuagccggg

SEQ ID NO: 5283 - RNA, 27 nt, Artificial Sequence
  Synthetic Oligonucleotide
uuuuguuggaaaagaacgacacccuuu

SEQ ID NO: 5284 - RNA, 27 nt, Artificial Sequence
  Synthetic Oligonucleotide
ugaaaguccauuucuuucuaaaagguu

SEQ ID NO: 5285 - RNA, 27 nt, Artificial Sequence
  Synthetic Oligonucleotide
cacccauugaaaagucaaaagcaauga

SEQ ID NO: 5286 - RNA, 27 nt, Artificial Sequence
  Synthetic Oligonucleotide
ugaugucagucuucucagccauuugau

SEQ ID NO: 5287 - RNA, 27 nt, Artificial Sequence
  Synthetic Oligonucleotide
gauugcuauuuuguuggaaaagaacga

SEQ ID NO: 5288 - RNA, 27 nt, Artificial Sequence
  Synthetic Oligonucleotide
cuauuuuguuggaaaagaacgacaccc

SEQ ID NO: 5289 - RNA, 27 nt, Artificial Sequence
  Synthetic Oligonucleotide
cauguaaacagaauacagguuaauaaa

SEQ ID NO: 5290 - RNA, 27 nt, Artificial Sequence
  Synthetic Oligonucleotide
acuuugaaccugagcuuacaauuuaag

SEQ ID NO: 5291 - RNA, 27 nt, Artificial Sequence
  Synthetic Oligonucleotide
uggcaaugaugucagucuucucagcca

SEQ ID NO: 5292 - RNA, 27 nt, Artificial Sequence
  Synthetic Oligonucleotide
acagaucuguuucagcaacauuccgga

SEQ ID NO: 5293 - RNA, 27 nt, Artificial Sequence
  Synthetic Oligonucleotide
acauccuaaaacauuuggauauauuca

SEQ ID NO: 5294 - RNA, 27 nt, Artificial Sequence
  Synthetic Oligonucleotide
uauugaaguggggaauuacagacugug

SEQ ID NO: 5295 - RNA, 27 nt, Artificial Sequence
  Synthetic Oligonucleotide
uccuuguagauauacaguugcagccaa

SEQ ID NO: 5296 - RNA, 27 nt, Artificial Sequence
  Synthetic Oligonucleotide
ucaauguuuucuuuuuaacaguuaaua

SEQ ID NO: 5297 - RNA, 27 nt, Artificial Sequence
  Synthetic Oligonucleotide
uauuaucagccaaaguuucuucaucau

SEQ ID NO: 5298 - RNA, 27 nt, Artificial Sequence
  Synthetic Oligonucleotide
uuggaaguacugauuuagcauguuguu

SEQ ID NO: 5299 - RNA, 27 nt, Artificial Sequence
  Synthetic Oligonucleotide
aucuacauucaaagaaguaucaccaau

SEQ ID NO: 5300 - RNA, 27 nt, Artificial Sequence
  Synthetic Oligonucleotide
gugcuaccuucucaaaguugugaauca

SEQ ID NO: 5301 - RNA, 27 nt, Artificial Sequence
  Synthetic Oligonucleotide
ccauugaaaagucaaaagcaaugaaau

SEQ ID NO: 5302 - RNA, 27 nt, Artificial Sequence
  Synthetic Oligonucleotide
uuggauacagcuuccaucuggaaaaug

SEQ ID NO: 5303 - RNA, 27 nt, Artificial Sequence
  Synthetic Oligonucleotide
guuuuaaagacauguaaacagaauaca

SEQ ID NO: 5304 - RNA, 27 nt, Artificial Sequence
  Synthetic Oligonucleotide
cucugcacagugucucuuugucaagua

SEQ ID NO: 5305 - RNA, 27 nt, Artificial Sequence
  Synthetic Oligonucleotide
aucaggcauuaccaacacuuugaaccu

SEQ ID NO: 5306 - RNA, 27 nt, Artificial Sequence
  Synthetic Oligonucleotide
auuuucaauguuuucuuuuuaacaguu

SEQ ID NO: 5307 - RNA, 27 nt, Artificial Sequence
  Synthetic Oligonucleotide
uggaaaagaacgacacccuuuguauug

SEQ ID NO: 5308 - RNA, 27 nt, Artificial Sequence
  Synthetic Oligonucleotide
uuuuccucaggagaaaaugauaaagua

SEQ ID NO: 5309 - RNA, 27 nt, Artificial Sequence
  Synthetic Oligonucleotide
acaauuuaagaaccacuguuuuaaaga

SEQ ID NO: 5310 - RNA, 27 nt, Artificial Sequence
  Synthetic Oligonucleotide
uauucagacacuaaagaugugauugga

SEQ ID NO: 5311 - RNA, 27 nt, Artificial Sequence
  Synthetic Oligonucleotide
guaauagucauauauagacuuuggaag

SEQ ID NO: 5312 - RNA, 27 nt, Artificial Sequence
  Synthetic Oligonucleotide
aaauuuuccucaggagaaaaugauaaa

SEQ ID NO: 5313 - RNA, 27 nt, Artificial Sequence
  Synthetic Oligonucleotide
cuuuauuucucucuaagaaguaacaua

SEQ ID NO: 5314 - RNA, 27 nt, Artificial Sequence
  Synthetic Oligonucleotide
uccucaggagaaaaugauaaaguacug

SEQ ID NO: 5315 - RNA, 27 nt, Artificial Sequence
  Synthetic Oligonucleotide
ugggaaaauauugugcacugucagauc

SEQ ID NO: 5316 - RNA, 27 nt, Artificial Sequence
  Synthetic Oligonucleotide
uccuuuaguaucucgaggacaucuuga

SEQ ID NO: 5317 - RNA, 27 nt, Artificial Sequence
  Synthetic Oligonucleotide
ucugcacagugucucuuugucaaguaa

SEQ ID NO: 5318 - RNA, 27 nt, Artificial Sequence
  Synthetic Oligonucleotide
ccuucucaaaguugugaaucaggcauu

SEQ ID NO: 5319 - RNA, 27 nt, Artificial Sequence
  Synthetic Oligonucleotide
guacugauuuagcauguuguucauaau

SEQ ID NO: 5320 - RNA, 27 nt, Artificial Sequence
  Synthetic Oligonucleotide
caacacuuugaaccugagcuuacaauu

SEQ ID NO: 5321 - RNA, 27 nt, Artificial Sequence
  Synthetic Oligonucleotide
uauuuccaggaugaaaguccauuucuu

SEQ ID NO: 5322 - RNA, 27 nt, Artificial Sequence
  Synthetic Oligonucleotide
auuuuacuaaaggauacagcacuuuag

SEQ ID NO: 5323 - RNA, 27 nt, Artificial Sequence
  Synthetic Oligonucleotide
ugacuuucacauucuggcacccacuca

SEQ ID NO: 5324 - RNA, 27 nt, Artificial Sequence
  Synthetic Oligonucleotide
uucucucuaagaaguaacauacauccu

SEQ ID NO: 5325 - RNA, 27 nt, Artificial Sequence
  Synthetic Oligonucleotide
ccaaugucuugucgaugacuuucacau

SEQ ID NO: 5326 - RNA, 27 nt, Artificial Sequence
  Synthetic Oligonucleotide
cagucuucucagccauuugauaucuuc

SEQ ID NO: 5327 - RNA, 27 nt, Artificial Sequence
  Synthetic Oligonucleotide
acuguuuuaaagacauguaaacagaau

SEQ ID NO: 5328 - RNA, 27 nt, Artificial Sequence
  Synthetic Oligonucleotide
agaucauuaucuuuucaccuuaguguu

SEQ ID NO: 5329 - RNA, 27 nt, Artificial Sequence
  Synthetic Oligonucleotide
agaccuguaauagucauauauagacuu

SEQ ID NO: 5330 - RNA, 27 nt, Artificial Sequence
  Synthetic Oligonucleotide
uuuccucaggagaaaaugauaaaguac

SEQ ID NO: 5331 - RNA, 27 nt, Artificial Sequence
  Synthetic Oligonucleotide
uacagcuuccaucuggaaaaugcugca

SEQ ID NO: 5332 - RNA, 27 nt, Artificial Sequence
  Synthetic Oligonucleotide
uuuggauauauucagacacuaaagaug

SEQ ID NO: 5333 - RNA, 27 nt, Artificial Sequence
  Synthetic Oligonucleotide
gucgaugacuuucacauucuggcaccc

SEQ ID NO: 5334 - RNA, 27 nt, Artificial Sequence
  Synthetic Oligonucleotide
auuucucucuaagaaguaacauacauc

SEQ ID NO: 5335 - RNA, 27 nt, Artificial Sequence
  Synthetic Oligonucleotide
caaugaugucagucuucucagccauuu

SEQ ID NO: 5336 - RNA, 27 nt, Artificial Sequence
  Synthetic Oligonucleotide
uggauauauucagacacuaaagaugug

SEQ ID NO: 5337 - RNA, 27 nt, Artificial Sequence
  Synthetic Oligonucleotide
cugcaauauuaucagccaaaguuucuu

SEQ ID NO: 5338 - RNA, 27 nt, Artificial Sequence
  Synthetic Oligonucleotide
uuccuuuaguaucucgaggacaucuug

SEQ ID NO: 5339 - RNA, 27 nt, Artificial Sequence
  Synthetic Oligonucleotide
uuuccucaccaaugucuugucgaugac

SEQ ID NO: 5340 - RNA, 27 nt, Artificial Sequence
  Synthetic Oligonucleotide
ggaaaauauugugcacugucagaucuu

SEQ ID NO: 5341 - RNA, 27 nt, Artificial Sequence
  Synthetic Oligonucleotide
accuucucaaaguugugaaucaggcau

SEQ ID NO: 5342 - RNA, 27 nt, Artificial Sequence
  Synthetic Oligonucleotide
ucuauugcuuuagccacauaugcagca

SEQ ID NO: 5343 - RNA, 27 nt, Artificial Sequence
  Synthetic Oligonucleotide
aguccauuucuuucuaaaagguuccua

SEQ ID NO: 5344 - RNA, 27 nt, Artificial Sequence
  Synthetic Oligonucleotide
aaucaggcauuaccaacacuuugaacc

SEQ ID NO: 5345 - RNA, 27 nt, Artificial Sequence
  Synthetic Oligonucleotide
cuccaauuuuacuaaaggauacagcac

SEQ ID NO: 5346 - RNA, 27 nt, Artificial Sequence
  Synthetic Oligonucleotide
aaaauuuuucauccugaguuguggcgg

SEQ ID NO: 5347 - RNA, 27 nt, Artificial Sequence
  Synthetic Oligonucleotide
ggauauauucagacacuaaagauguga

SEQ ID NO: 5348 - RNA, 27 nt, Artificial Sequence
  Synthetic Oligonucleotide
ucaggcauuaccaacacuuugaaccug

SEQ ID NO: 5349 - RNA, 27 nt, Artificial Sequence
  Synthetic Oligonucleotide
uccaaaauuuuccucaggagaaaauga

SEQ ID NO: 5350 - RNA, 27 nt, Artificial Sequence
  Synthetic Oligonucleotide
uuguagauauacaguugcagccaacga

SEQ ID NO: 5351 - RNA, 27 nt, Artificial Sequence
  Synthetic Oligonucleotide
agauauacaguugcagccaacgaagug

SEQ ID NO: 5352 - RNA, 27 nt, Artificial Sequence
  Synthetic Oligonucleotide
gaaaagucaaaagcaaugaaauaaaag

SEQ ID NO: 5353 - RNA, 27 nt, Artificial Sequence
  Synthetic Oligonucleotide
aaaaaauaauacagaugggaaaauauu

SEQ ID NO: 5354 - RNA, 27 nt, Artificial Sequence
  Synthetic Oligonucleotide
ccuuugcaacaauuggcaaugauguca

SEQ ID NO: 5355 - RNA, 27 nt, Artificial Sequence
  Synthetic Oligonucleotide
auucuucccaaaaaugcuuuauuucuc

SEQ ID NO: 5356 - RNA, 27 nt, Artificial Sequence
  Synthetic Oligonucleotide
guauugaaguggggaauuacagacugu

SEQ ID NO: 5357 - RNA, 27 nt, Artificial Sequence
  Synthetic Oligonucleotide
auuggcaaugaugucagucuucucagc

SEQ ID NO: 5358 - RNA, 27 nt, Artificial Sequence
  Synthetic Oligonucleotide
agggauugcuauuuuguuggaaaagaa

SEQ ID NO: 5359 - RNA, 27 nt, Artificial Sequence
  Synthetic Oligonucleotide
aauuucuggcagaacaucaauaguggc

SEQ ID NO: 5360 - RNA, 27 nt, Artificial Sequence
  Synthetic Oligonucleotide
uggaaguacugauuuagcauguuguuc

SEQ ID NO: 5361 - RNA, 27 nt, Artificial Sequence
  Synthetic Oligonucleotide
uuugcuaccuccaauuuuacuaaagga

SEQ ID NO: 5362 - RNA, 27 nt, Artificial Sequence
  Synthetic Oligonucleotide
aggacacccauugaaaagucaaaagca

SEQ ID NO: 5363 - RNA, 27 nt, Artificial Sequence
  Synthetic Oligonucleotide
augaaaguccauuucuuucuaaaaggu

SEQ ID NO: 5364 - RNA, 27 nt, Artificial Sequence
  Synthetic Oligonucleotide
auauucagacacuaaagaugugauugg

SEQ ID NO: 5365 - RNA, 27 nt, Artificial Sequence
  Synthetic Oligonucleotide
cuuccaucuggaaaaugcugcaauauu

SEQ ID NO: 5366 - RNA, 27 nt, Artificial Sequence
  Synthetic Oligonucleotide
ccuuguagauauacaguugcagccaac

SEQ ID NO: 5367 - RNA, 27 nt, Artificial Sequence
  Synthetic Oligonucleotide
ugcacagugucucuuugucaaguaaua

SEQ ID NO: 5368 - RNA, 27 nt, Artificial Sequence
  Synthetic Oligonucleotide
uuugauaucuucccagcugauagaugg

SEQ ID NO: 5369 - RNA, 27 nt, Artificial Sequence
  Synthetic Oligonucleotide
acauuuggauauauucagacacuaaag

SEQ ID NO: 5370 - RNA, 27 nt, Artificial Sequence
  Synthetic Oligonucleotide
auauauucagacacuaaagaugugauu

SEQ ID NO: 5371 - RNA, 27 nt, Artificial Sequence
  Synthetic Oligonucleotide
caaaagcaaugaaauaaaagggauugc

SEQ ID NO: 5372 - RNA, 27 nt, Artificial Sequence
  Synthetic Oligonucleotide
auuuggauauauucagacacuaaagau

SEQ ID NO: 5373 - RNA, 27 nt, Artificial Sequence
  Synthetic Oligonucleotide
agacauguaaacagaauacagguuaau

SEQ ID NO: 5374 - RNA, 27 nt, Artificial Sequence
  Synthetic Oligonucleotide
cccuuugcaacaauuggcaaugauguc

SEQ ID NO: 5375 - RNA, 27 nt, Artificial Sequence
  Synthetic Oligonucleotide
uuuguuggaaaagaacgacacccuuug

SEQ ID NO: 5376 - RNA, 27 nt, Artificial Sequence
  Synthetic Oligonucleotide
aauucuuccuuuaguaucucgaggaca

SEQ ID NO: 5377 - RNA, 27 nt, Artificial Sequence
  Synthetic Oligonucleotide
ugcuuuauuucucucuaagaaguaaca

SEQ ID NO: 5378 - RNA, 27 nt, Artificial Sequence
  Synthetic Oligonucleotide
guuggaaaagaacgacacccuuuguau

SEQ ID NO: 5379 - RNA, 27 nt, Artificial Sequence
  Synthetic Oligonucleotide
cucucuaagaaguaacauacauccuaa

SEQ ID NO: 5380 - RNA, 27 nt, Artificial Sequence
  Synthetic Oligonucleotide
ggaaaaugcugcaauauuaucagccaa

SEQ ID NO: 5381 - RNA, 27 nt, Artificial Sequence
  Synthetic Oligonucleotide
aauauugugcacugucagaucuuggaa

SEQ ID NO: 5382 - RNA, 27 nt, Artificial Sequence
  Synthetic Oligonucleotide
augaugucagucuucucagccauuuga

SEQ ID NO: 5383 - RNA, 27 nt, Artificial Sequence
  Synthetic Oligonucleotide
uaauagucauauauagacuuuggaagu

SEQ ID NO: 5384 - RNA, 27 nt, Artificial Sequence
  Synthetic Oligonucleotide
ucccaaaaaugcuuuauuucucucuaa

SEQ ID NO: 5385 - RNA, 27 nt, Artificial Sequence
  Synthetic Oligonucleotide
augcuuuauuucucucuaagaaguaac

SEQ ID NO: 5386 - RNA, 27 nt, Artificial Sequence
  Synthetic Oligonucleotide
ucgaugacuuucacauucuggcaccca

SEQ ID NO: 5387 - RNA, 27 nt, Artificial Sequence
  Synthetic Oligonucleotide
ggcauuaccaacacuuugaaccugagc

SEQ ID NO: 5388 - RNA, 27 nt, Artificial Sequence
  Synthetic Oligonucleotide
uuccaauucucuccagugcuaccuucu

SEQ ID NO: 5389 - RNA, 27 nt, Artificial Sequence
  Synthetic Oligonucleotide
gagaucauuaucuuuucaccuuagugu

SEQ ID NO: 5390 - RNA, 27 nt, Artificial Sequence
  Synthetic Oligonucleotide
uccaucuggaaaaugcugcaauauuau

SEQ ID NO: 5391 - RNA, 27 nt, Artificial Sequence
  Synthetic Oligonucleotide
auuuccaggaugaaaguccauuucuuu

SEQ ID NO: 5392 - RNA, 27 nt, Artificial Sequence
  Synthetic Oligonucleotide
ccaaaaaugcuuuauuucucucuaaga

SEQ ID NO: 5393 - RNA, 27 nt, Artificial Sequence
  Synthetic Oligonucleotide
accugagcuuacaauuuaagaaccacu

SEQ ID NO: 5394 - RNA, 27 nt, Artificial Sequence
  Synthetic Oligonucleotide
aauuuuccucaggagaaaaugauaaag

SEQ ID NO: 5395 - RNA, 27 nt, Artificial Sequence
  Synthetic Oligonucleotide
uuggaaaucuacauucaaagaaguauc

SEQ ID NO: 5396 - RNA, 27 nt, Artificial Sequence
  Synthetic Oligonucleotide
uugaaccugagcuuacaauuuaagaac

SEQ ID NO: 5397 - RNA, 27 nt, Artificial Sequence
  Synthetic Oligonucleotide
gacuuuggaaguacugauuuagcaugu

SEQ ID NO: 5398 - RNA, 27 nt, Artificial Sequence
  Synthetic Oligonucleotide
ucgacagaucuguuucagcaacauucc

SEQ ID NO: 5399 - RNA, 27 nt, Artificial Sequence
  Synthetic Oligonucleotide
ccaacacuuugaaccugagcuuacaau

SEQ ID NO: 5400 - RNA, 27 nt, Artificial Sequence
  Synthetic Oligonucleotide
uguccuaaaacagaagucgacagaucu

SEQ ID NO: 5401 - RNA, 27 nt, Artificial Sequence
  Synthetic Oligonucleotide
uccacugucacaaauauggccuuguag

SEQ ID NO: 5402 - RNA, 27 nt, Artificial Sequence
  Synthetic Oligonucleotide
uaagaaccacuguuuuaaagacaugua

SEQ ID NO: 5403 - RNA, 27 nt, Artificial Sequence
  Synthetic Oligonucleotide
acccuuuguauugaaguggggaauuac

SEQ ID NO: 5404 - RNA, 27 nt, Artificial Sequence
  Synthetic Oligonucleotide
ugaaucuguuacgcacaucauccagac

SEQ ID NO: 5405 - RNA, 27 nt, Artificial Sequence
  Synthetic Oligonucleotide
uuuucaccuuaguguuugcuaccucca

SEQ ID NO: 5406 - RNA, 27 nt, Artificial Sequence
  Synthetic Oligonucleotide
caaaaaugcuuuauuucucucuaagaa

SEQ ID NO: 5407 - RNA, 27 nt, Artificial Sequence
  Synthetic Oligonucleotide
uaagaaguaacauacauccuaaaacau

SEQ ID NO: 5408 - RNA, 27 nt, Artificial Sequence
  Synthetic Oligonucleotide
auucuuccuuuaguaucucgaggacau

SEQ ID NO: 5409 - RNA, 27 nt, Artificial Sequence
  Synthetic Oligonucleotide
cuaccuucucaaaguugugaaucaggc

SEQ ID NO: 5410 - RNA, 27 nt, Artificial Sequence
  Synthetic Oligonucleotide
cacuguuuuaaagacauguaaacagaa

SEQ ID NO: 5411 - RNA, 27 nt, Artificial Sequence
  Synthetic Oligonucleotide
ucagucuucucagccauuugauaucuu

SEQ ID NO: 5412 - RNA, 27 nt, Artificial Sequence
  Synthetic Oligonucleotide
gaaaaugcugcaauauuaucagccaaa

SEQ ID NO: 5413 - RNA, 27 nt, Artificial Sequence
  Synthetic Oligonucleotide
cauccuuggauacagcuuccaucugga

SEQ ID NO: 5414 - RNA, 27 nt, Artificial Sequence
  Synthetic Oligonucleotide
uagauauacaguugcagccaacgaagu

SEQ ID NO: 5415 - RNA, 27 nt, Artificial Sequence
  Synthetic Oligonucleotide
auuccaauucucuccagugcuaccuuc

SEQ ID NO: 5416 - RNA, 27 nt, Artificial Sequence
  Synthetic Oligonucleotide
agucgacagaucuguuucagcaacauu

SEQ ID NO: 5417 - RNA, 27 nt, Artificial Sequence
  Synthetic Oligonucleotide
cuuguagauauacaguugcagccaacg

SEQ ID NO: 5418 - RNA, 27 nt, Artificial Sequence
  Synthetic Oligonucleotide
ccaggaugaaaguccauuucuuucuaa

SEQ ID NO: 5419 - RNA, 27 nt, Artificial Sequence
  Synthetic Oligonucleotide
aauacagaugggaaaauauugugcacu

SEQ ID NO: 5420 - RNA, 27 nt, Artificial Sequence
  Synthetic Oligonucleotide
auacagaugggaaaauauugugcacug

SEQ ID NO: 5421 - RNA, 27 nt, Artificial Sequence
  Synthetic Oligonucleotide
agugcuaccuucucaaaguugugaauc

SEQ ID NO: 5422 - RNA, 27 nt, Artificial Sequence
  Synthetic Oligonucleotide
ucuguuucagcaacauuccggagcauc

SEQ ID NO: 5423 - RNA, 27 nt, Artificial Sequence
  Synthetic Oligonucleotide
aaaagaacgacacccuuuguauugaag

SEQ ID NO: 5424 - RNA, 27 nt, Artificial Sequence
  Synthetic Oligonucleotide
cucgguccuuguagauauacaguugca

SEQ ID NO: 5425 - RNA, 27 nt, Artificial Sequence
  Synthetic Oligonucleotide
agaugugauuggaaaucuacauucaaa

SEQ ID NO: 5426 - RNA, 27 nt, Artificial Sequence
  Synthetic Oligonucleotide
uuucucucuaagaaguaacauacaucc

SEQ ID NO: 5427 - RNA, 27 nt, Artificial Sequence
  Synthetic Oligonucleotide
aagaaguaacauacauccuaaaacauu

SEQ ID NO: 5428 - RNA, 27 nt, Artificial Sequence
  Synthetic Oligonucleotide
caguuugaaucuguuacgcacaucauc

SEQ ID NO: 5429 - RNA, 27 nt, Artificial Sequence
  Synthetic Oligonucleotide
aguguuugcuaccuccaauuuuacuaa

SEQ ID NO: 5430 - RNA, 27 nt, Artificial Sequence
  Synthetic Oligonucleotide
aguaucucgaggacaucuugaacaccu

SEQ ID NO: 5431 - RNA, 27 nt, Artificial Sequence
  Synthetic Oligonucleotide
aaugcuuuauuucucucuaagaaguaa

SEQ ID NO: 5432 - RNA, 27 nt, Artificial Sequence
  Synthetic Oligonucleotide
cagaugggaaaauauugugcacuguca

SEQ ID NO: 5433 - RNA, 27 nt, Artificial Sequence
  Synthetic Oligonucleotide
guaucucgaggacaucuugaacaccuu

SEQ ID NO: 5434 - RNA, 27 nt, Artificial Sequence
  Synthetic Oligonucleotide
gcuuuauuucucucuaagaaguaacau

SEQ ID NO: 5435 - RNA, 27 nt, Artificial Sequence
  Synthetic Oligonucleotide
uuggaaaagaacgacacccuuuguauu

SEQ ID NO: 5436 - RNA, 27 nt, Artificial Sequence
  Synthetic Oligonucleotide
uuaagaaccacuguuuuaaagacaugu

SEQ ID NO: 5437 - RNA, 27 nt, Artificial Sequence
  Synthetic Oligonucleotide
gaauuacagacuguggucacccucugc

SEQ ID NO: 5438 - RNA, 27 nt, Artificial Sequence
  Synthetic Oligonucleotide
uucagcaacauuccggagcauccuugg

SEQ ID NO: 5439 - RNA, 27 nt, Artificial Sequence
  Synthetic Oligonucleotide
cuucccaaaaaugcuuuauuucucucu

SEQ ID NO: 5440 - RNA, 27 nt, Artificial Sequence
  Synthetic Oligonucleotide
augugauuggaaaucuacauucaaaga

SEQ ID NO: 5441 - RNA, 27 nt, Artificial Sequence
  Synthetic Oligonucleotide
accacuguuuuaaagacauguaaacag

SEQ ID NO: 5442 - RNA, 27 nt, Artificial Sequence
  Synthetic Oligonucleotide
ucaccuuaguguuugcuaccuccaauu

SEQ ID NO: 5443 - RNA, 27 nt, Artificial Sequence
  Synthetic Oligonucleotide
agcugauagaugggucuauugcuuuag

SEQ ID NO: 5444 - RNA, 27 nt, Artificial Sequence
  Synthetic Oligonucleotide
cuuuggaaguacugauuuagcauguug

SEQ ID NO: 5445 - RNA, 27 nt, Artificial Sequence
  Synthetic Oligonucleotide
gauuggaaaucuacauucaaagaagua

SEQ ID NO: 5446 - RNA, 27 nt, Artificial Sequence
  Synthetic Oligonucleotide
ucaaaaugcccuuugcaacaauuggca

SEQ ID NO: 5447 - RNA, 27 nt, Artificial Sequence
  Synthetic Oligonucleotide
uuuacuaaaggauacagcacuuuagcc

SEQ ID NO: 5448 - RNA, 27 nt, Artificial Sequence
  Synthetic Oligonucleotide
gcacagugucucuuugucaaguaauac

SEQ ID NO: 5449 - RNA, 27 nt, Artificial Sequence
  Synthetic Oligonucleotide
ugaaccugagcuuacaauuuaagaacc

SEQ ID NO: 5450 - RNA, 27 nt, Artificial Sequence
  Synthetic Oligonucleotide
aaaacagaagucgacagaucuguuuca

SEQ ID NO: 5451 - RNA, 27 nt, Artificial Sequence
  Synthetic Oligonucleotide
ccaucuggaaaaugcugcaauauuauc

SEQ ID NO: 5452 - RNA, 27 nt, Artificial Sequence
  Synthetic Oligonucleotide
ugcuaccuucucaaaguugugaaucag

SEQ ID NO: 5453 - RNA, 27 nt, Artificial Sequence
  Synthetic Oligonucleotide
ggucuauugcuuuagccacauaugcag

SEQ ID NO: 5454 - RNA, 27 nt, Artificial Sequence
  Synthetic Oligonucleotide
auuuuguuggaaaagaacgacacccuu

SEQ ID NO: 5455 - RNA, 27 nt, Artificial Sequence
  Synthetic Oligonucleotide
ucuguuacgcacaucauccagacgguu

SEQ ID NO: 5456 - RNA, 27 nt, Artificial Sequence
  Synthetic Oligonucleotide
uccauuucuuucuaaaagguuccuagg

SEQ ID NO: 5457 - RNA, 27 nt, Artificial Sequence
  Synthetic Oligonucleotide
uuucuggcagaacaucaauaguggcug

SEQ ID NO: 5458 - RNA, 27 nt, Artificial Sequence
  Synthetic Oligonucleotide
gaaaagaacgacacccuuuguauugaa

SEQ ID NO: 5459 - RNA, 27 nt, Artificial Sequence
  Synthetic Oligonucleotide
gugauuggaaaucuacauucaaagaag

SEQ ID NO: 5460 - RNA, 27 nt, Artificial Sequence
  Synthetic Oligonucleotide
guagauauacaguugcagccaacgaag

SEQ ID NO: 5461 - RNA, 27 nt, Artificial Sequence
  Synthetic Oligonucleotide
ggggagcauuuucacagguuauugcua

SEQ ID NO: 5462 - RNA, 27 nt, Artificial Sequence
  Synthetic Oligonucleotide
gaccuguaauagucauauauagacuuu

SEQ ID NO: 5463 - RNA, 27 nt, Artificial Sequence
  Synthetic Oligonucleotide
ccaaaauuuuccucaggagaaaaugau

SEQ ID NO: 5464 - RNA, 27 nt, Artificial Sequence
  Synthetic Oligonucleotide
gggucuauugcuuuagccacauaugca

SEQ ID NO: 5465 - RNA, 27 nt, Artificial Sequence
  Synthetic Oligonucleotide
cacauaugcagcaaguccacugucguc

SEQ ID NO: 5466 - RNA, 27 nt, Artificial Sequence
  Synthetic Oligonucleotide
uauugugcacugucagaucuuggaaac

SEQ ID NO: 5467 - RNA, 27 nt, Artificial Sequence
  Synthetic Oligonucleotide
uuaucagccaaaguuucuucaucauuu

SEQ ID NO: 5468 - RNA, 27 nt, Artificial Sequence
  Synthetic Oligonucleotide
ggaauuacagacuguggucacccucug

SEQ ID NO: 5469 - RNA, 27 nt, Artificial Sequence
  Synthetic Oligonucleotide
uucuucccaaaaaugcuuuauuucucu

SEQ ID NO: 5470 - RNA, 27 nt, Artificial Sequence
  Synthetic Oligonucleotide
augauucgacaccaagaucccauucaa

SEQ ID NO: 5471 - RNA, 27 nt, Artificial Sequence
  Synthetic Oligonucleotide
ccuuuguauugaaguggggaauuacag

SEQ ID NO: 5472 - RNA, 27 nt, Artificial Sequence
  Synthetic Oligonucleotide
ccuccaauuuuacuaaaggauacagca

SEQ ID NO: 5473 - RNA, 27 nt, Artificial Sequence
  Synthetic Oligonucleotide
uccaauucucuccagugcuaccuucuc

SEQ ID NO: 5474 - RNA, 27 nt, Artificial Sequence
  Synthetic Oligonucleotide
uucuggcagaacaucaauaguggcugg

SEQ ID NO: 5475 - RNA, 27 nt, Artificial Sequence
  Synthetic Oligonucleotide
agaugggaaaauauugugcacugucag

SEQ ID NO: 5476 - RNA, 27 nt, Artificial Sequence
  Synthetic Oligonucleotide
auuucuuucuaaaagguuccuaggaca

SEQ ID NO: 5477 - RNA, 27 nt, Artificial Sequence
  Synthetic Oligonucleotide
caugauucgacaccaagaucccauuca

SEQ ID NO: 5478 - RNA, 27 nt, Artificial Sequence
  Synthetic Oligonucleotide
gggaauuacagacuguggucacccucu

SEQ ID NO: 5479 - RNA, 27 nt, Artificial Sequence
  Synthetic Oligonucleotide
gggaaaauauugugcacugucagaucu

SEQ ID NO: 5480 - RNA, 27 nt, Artificial Sequence
  Synthetic Oligonucleotide
auagucauauauagacuuuggaaguac

SEQ ID NO: 5481 - RNA, 27 nt, Artificial Sequence
  Synthetic Oligonucleotide
caggaugaaaguccauuucuuucuaaa

SEQ ID NO: 5482 - RNA, 27 nt, Artificial Sequence
  Synthetic Oligonucleotide
augacuuucacauucuggcacccacuc

SEQ ID NO: 5483 - RNA, 27 nt, Artificial Sequence
  Synthetic Oligonucleotide
cacugucgucuccaaaauuuuccucag

SEQ ID NO: 5484 - RNA, 27 nt, Artificial Sequence
  Synthetic Oligonucleotide
agaacaucaauaguggcuggcacccca

SEQ ID NO: 5485 - RNA, 27 nt, Artificial Sequence
  Synthetic Oligonucleotide
auaaucauugauacaaauuagccgggg

SEQ ID NO: 5486 - RNA, 27 nt, Artificial Sequence
  Synthetic Oligonucleotide
aauuacagacuguggucacccucugca

SEQ ID NO: 5487 - RNA, 27 nt, Artificial Sequence
  Synthetic Oligonucleotide
uguccacugucacaaauauggccuugu

SEQ ID NO: 5488 - RNA, 27 nt, Artificial Sequence
  Synthetic Oligonucleotide
caauuuaagaaccacuguuuuaaagac

SEQ ID NO: 5489 - RNA, 27 nt, Artificial Sequence
  Synthetic Oligonucleotide
ggaauucuuccuuuaguaucucgagga

SEQ ID NO: 5490 - RNA, 27 nt, Artificial Sequence
  Synthetic Oligonucleotide
ccagcugauagaugggucuauugcuuu

SEQ ID NO: 5491 - RNA, 27 nt, Artificial Sequence
  Synthetic Oligonucleotide
uggauacagcuuccaucuggaaaaugc

SEQ ID NO: 5492 - RNA, 27 nt, Artificial Sequence
  Synthetic Oligonucleotide
agacuuuggaaguacugauuuagcaug

SEQ ID NO: 5493 - RNA, 27 nt, Artificial Sequence
  Synthetic Oligonucleotide
gaugaaaguccauuucuuucuaaaagg

SEQ ID NO: 5494 - RNA, 27 nt, Artificial Sequence
  Synthetic Oligonucleotide
uuccucaggagaaaaugauaaaguacu

SEQ ID NO: 5495 - RNA, 27 nt, Artificial Sequence
  Synthetic Oligonucleotide
auauagacuuuggaaguacugauuuag

SEQ ID NO: 5496 - RNA, 27 nt, Artificial Sequence
  Synthetic Oligonucleotide
ccuaaaacagaagucgacagaucuguu

SEQ ID NO: 5497 - RNA, 27 nt, Artificial Sequence
  Synthetic Oligonucleotide
caaaggauuuuuccucaccaaugucuu

SEQ ID NO: 5498 - RNA, 27 nt, Artificial Sequence
  Synthetic Oligonucleotide
uaaaagggauugcuauuuuguuggaaa

SEQ ID NO: 5499 - RNA, 27 nt, Artificial Sequence
  Synthetic Oligonucleotide
cuaaaacagaagucgacagaucuguuu

SEQ ID NO: 5500 - RNA, 27 nt, Artificial Sequence
  Synthetic Oligonucleotide
uucucgguccuuguagauauacaguug

SEQ ID NO: 5501 - RNA, 27 nt, Artificial Sequence
  Synthetic Oligonucleotide
gcuaccuucucaaaguugugaaucagg

SEQ ID NO: 5502 - RNA, 27 nt, Artificial Sequence
  Synthetic Oligonucleotide
ugcugcaauauuaucagccaaaguuuc

SEQ ID NO: 5503 - RNA, 27 nt, Artificial Sequence
  Synthetic Oligonucleotide
auucagacacuaaagaugugauuggaa

SEQ ID NO: 5504 - RNA, 27 nt, Artificial Sequence
  Synthetic Oligonucleotide
aucuguuucagcaacauuccggagcau

SEQ ID NO: 5505 - RNA, 27 nt, Artificial Sequence
  Synthetic Oligonucleotide
cccuuuguauugaaguggggaauuaca

SEQ ID NO: 5506 - RNA, 27 nt, Artificial Sequence
  Synthetic Oligonucleotide
gaaaguccauuucuuucuaaaagguuc

SEQ ID NO: 5507 - RNA, 27 nt, Artificial Sequence
  Synthetic Oligonucleotide
uaguaucucgaggacaucuugaacacc

SEQ ID NO: 5508 - RNA, 27 nt, Artificial Sequence
  Synthetic Oligonucleotide
cacccuuuguauugaaguggggaauua

SEQ ID NO: 5509 - RNA, 27 nt, Artificial Sequence
  Synthetic Oligonucleotide
guccuuguagauauacaguugcagcca

SEQ ID NO: 5510 - RNA, 27 nt, Artificial Sequence
  Synthetic Oligonucleotide
auuuaagaaccacuguuuuaaagacau

SEQ ID NO: 5511 - RNA, 27 nt, Artificial Sequence
  Synthetic Oligonucleotide
acauauuggcaugcugacccucugucc

SEQ ID NO: 5512 - RNA, 27 nt, Artificial Sequence
  Synthetic Oligonucleotide
cuuccuuuaguaucucgaggacaucuu

SEQ ID NO: 5513 - RNA, 27 nt, Artificial Sequence
  Synthetic Oligonucleotide
ucaaagaaguaucaccaauuaccgcca

SEQ ID NO: 5514 - RNA, 27 nt, Artificial Sequence
  Synthetic Oligonucleotide
aaaaaugcuuuauuucucucuaagaag

SEQ ID NO: 5515 - RNA, 27 nt, Artificial Sequence
  Synthetic Oligonucleotide
cuuaguguuugcuaccuccaauuuuac

SEQ ID NO: 5516 - RNA, 27 nt, Artificial Sequence
  Synthetic Oligonucleotide
aauuuaagaaccacuguuuuaaagaca

SEQ ID NO: 5517 - RNA, 27 nt, Artificial Sequence
  Synthetic Oligonucleotide
ucucucuaagaaguaacauacauccua

SEQ ID NO: 5518 - RNA, 27 nt, Artificial Sequence
  Synthetic Oligonucleotide
uaccuccaauuuuacuaaaggauacag

SEQ ID NO: 5519 - RNA, 27 nt, Artificial Sequence
  Synthetic Oligonucleotide
gauacagcuuccaucuggaaaaugcug

SEQ ID NO: 5520 - RNA, 27 nt, Artificial Sequence
  Synthetic Oligonucleotide
uccagugcuaccuucucaaaguuguga

SEQ ID NO: 5521 - RNA, 27 nt, Artificial Sequence
  Synthetic Oligonucleotide
gggauugcuauuuuguuggaaaagaac

SEQ ID NO: 5522 - RNA, 27 nt, Artificial Sequence
  Synthetic Oligonucleotide
gacuuucacauucuggcacccacucag

SEQ ID NO: 5523 - RNA, 27 nt, Artificial Sequence
  Synthetic Oligonucleotide
gaugucagucuucucagccauuugaua

SEQ ID NO: 5524 - RNA, 27 nt, Artificial Sequence
  Synthetic Oligonucleotide
aauuuuucauccugaguuguggcggca

SEQ ID NO: 5525 - RNA, 27 nt, Artificial Sequence
  Synthetic Oligonucleotide
guuucagcaacauuccggagcauccuu

SEQ ID NO: 5526 - RNA, 27 nt, Artificial Sequence
  Synthetic Oligonucleotide
cuuuucaccuuaguguuugcuaccucc

SEQ ID NO: 5527 - RNA, 27 nt, Artificial Sequence
  Synthetic Oligonucleotide
auugaaguggggaauuacagacugugg

SEQ ID NO: 5528 - RNA, 27 nt, Artificial Sequence
  Synthetic Oligonucleotide
gucgacagaucuguuucagcaacauuc

SEQ ID NO: 5529 - RNA, 27 nt, Artificial Sequence
  Synthetic Oligonucleotide
uauagacuuuggaaguacugauuuagc

SEQ ID NO: 5530 - RNA, 27 nt, Artificial Sequence
  Synthetic Oligonucleotide
ucucgguccuuguagauauacaguugc

SEQ ID NO: 5531 - RNA, 27 nt, Artificial Sequence
  Synthetic Oligonucleotide
acuuuggaaguacugauuuagcauguu

SEQ ID NO: 5532 - RNA, 27 nt, Artificial Sequence
  Synthetic Oligonucleotide
gucagucuucucagccauuugauaucu

SEQ ID NO: 5533 - RNA, 27 nt, Artificial Sequence
  Synthetic Oligonucleotide
aaaugcuuuauuucucucuaagaagua

SEQ ID NO: 5534 - RNA, 27 nt, Artificial Sequence
  Synthetic Oligonucleotide
aucuguuacgcacaucauccagacggu

SEQ ID NO: 5535 - RNA, 27 nt, Artificial Sequence
  Synthetic Oligonucleotide
caaaaugcccuuugcaacaauuggcaa

SEQ ID NO: 5536 - RNA, 27 nt, Artificial Sequence
  Synthetic Oligonucleotide
uguuggaaaagaacgacacccuuugua

SEQ ID NO: 5537 - RNA, 27 nt, Artificial Sequence
  Synthetic Oligonucleotide
uuccucaccaaugucuugucgaugacu

SEQ ID NO: 5538 - RNA, 27 nt, Artificial Sequence
  Synthetic Oligonucleotide
aaaugcugcaauauuaucagccaaagu

SEQ ID NO: 5539 - RNA, 27 nt, Artificial Sequence
  Synthetic Oligonucleotide
uugcuuuagccacauaugcagcaaguc

SEQ ID NO: 5540 - RNA, 27 nt, Artificial Sequence
  Synthetic Oligonucleotide
aagggauugcuauuuuguuggaaaaga

SEQ ID NO: 5541 - RNA, 27 nt, Artificial Sequence
  Synthetic Oligonucleotide
gaacgacacccuuuguauugaaguggg

SEQ ID NO: 5542 - RNA, 27 nt, Artificial Sequence
  Synthetic Oligonucleotide
acauacauccuaaaacauuuggauaua

SEQ ID NO: 5543 - RNA, 27 nt, Artificial Sequence
  Synthetic Oligonucleotide
auuugauaucuucccagcugauagaug

SEQ ID NO: 5544 - RNA, 27 nt, Artificial Sequence
  Synthetic Oligonucleotide
ccacauaugcagcaaguccacugucgu

SEQ ID NO: 5545 - RNA, 27 nt, Artificial Sequence
  Synthetic Oligonucleotide
uuucuuucuaaaagguuccuaggacac

SEQ ID NO: 5546 - RNA, 27 nt, Artificial Sequence
  Synthetic Oligonucleotide
ugaaguggggaauuacagacugugguc

SEQ ID NO: 5547 - RNA, 27 nt, Artificial Sequence
  Synthetic Oligonucleotide
cuguuacgcacaucauccagacgguug

SEQ ID NO: 5548 - RNA, 27 nt, Artificial Sequence
  Synthetic Oligonucleotide
gguccuuguagauauacaguugcagcc

SEQ ID NO: 5549 - RNA, 27 nt, Artificial Sequence
  Synthetic Oligonucleotide
ucagcaacauuccggagcauccuugga

SEQ ID NO: 5550 - RNA, 27 nt, Artificial Sequence
  Synthetic Oligonucleotide
uuucagcaacauuccggagcauccuug

SEQ ID NO: 5551 - RNA, 27 nt, Artificial Sequence
  Synthetic Oligonucleotide
aagucgacagaucuguuucagcaacau

SEQ ID NO: 5552 - RNA, 27 nt, Artificial Sequence
  Synthetic Oligonucleotide
caucaucaccucucaaaaugcccuuug

SEQ ID NO: 5553 - RNA, 27 nt, Artificial Sequence
  Synthetic Oligonucleotide
gcugauagaugggucuauugcuuuagc

SEQ ID NO: 5554 - RNA, 27 nt, Artificial Sequence
  Synthetic Oligonucleotide
ccuuuaguaucucgaggacaucuugaa

SEQ ID NO: 5555 - RNA, 27 nt, Artificial Sequence
  Synthetic Oligonucleotide
aaguggggaauuacagacuguggucac

SEQ ID NO: 5556 - RNA, 27 nt, Artificial Sequence
  Synthetic Oligonucleotide
cucaccaaugucuugucgaugacuuuc

SEQ ID NO: 5557 - RNA, 27 nt, Artificial Sequence
  Synthetic Oligonucleotide
ucuucucagccauuugauaucuuccca

SEQ ID NO: 5558 - RNA, 27 nt, Artificial Sequence
  Synthetic Oligonucleotide
ugucgucuccaaaauuuuccucaggag

SEQ ID NO: 5559 - RNA, 27 nt, Artificial Sequence
  Synthetic Oligonucleotide
ccuccacaauuucuggcagaacaucaa

SEQ ID NO: 5560 - RNA, 27 nt, Artificial Sequence
  Synthetic Oligonucleotide
cuggcagaacaucaauaguggcuggca

SEQ ID NO: 5561 - RNA, 27 nt, Artificial Sequence
  Synthetic Oligonucleotide
uuguuggaaaagaacgacacccuuugu

SEQ ID NO: 5562 - RNA, 27 nt, Artificial Sequence
  Synthetic Oligonucleotide
uuuuuccucaccaaugucuugucgaug

SEQ ID NO: 5563 - RNA, 27 nt, Artificial Sequence
  Synthetic Oligonucleotide
gagcuuucagaacaucagugccuuucc

SEQ ID NO: 5564 - RNA, 27 nt, Artificial Sequence
  Synthetic Oligonucleotide
uggggaauuacagacuguggucacccu

SEQ ID NO: 5565 - RNA, 27 nt, Artificial Sequence
  Synthetic Oligonucleotide
aaauuuuucauccugaguuguggcggc

SEQ ID NO: 5566 - RNA, 27 nt, Artificial Sequence
  Synthetic Oligonucleotide
caaagaaguaucaccaauuaccgccac

SEQ ID NO: 5567 - RNA, 27 nt, Artificial Sequence
  Synthetic Oligonucleotide
gacacccauugaaaagucaaaagcaau

SEQ ID NO: 5568 - RNA, 27 nt, Artificial Sequence
  Synthetic Oligonucleotide
ucuaaaagguuccuaggacacccauug

SEQ ID NO: 5569 - RNA, 27 nt, Artificial Sequence
  Synthetic Oligonucleotide
uucaccuuaguguuugcuaccuccaau

SEQ ID NO: 5570 - RNA, 27 nt, Artificial Sequence
  Synthetic Oligonucleotide
aacagaagucgacagaucuguuucagc

SEQ ID NO: 5571 - RNA, 27 nt, Artificial Sequence
  Synthetic Oligonucleotide
guccacugucacaaauauggccuugua

SEQ ID NO: 5572 - RNA, 27 nt, Artificial Sequence
  Synthetic Oligonucleotide
cagcuuccaucuggaaaaugcugcaau

SEQ ID NO: 5573 - RNA, 27 nt, Artificial Sequence
  Synthetic Oligonucleotide
auagacuuuggaaguacugauuuagca

SEQ ID NO: 5574 - RNA, 27 nt, Artificial Sequence
  Synthetic Oligonucleotide
ccugagcuuacaauuuaagaaccacug

SEQ ID NO: 5575 - RNA, 27 nt, Artificial Sequence
  Synthetic Oligonucleotide
acacccauugaaaagucaaaagcaaug

SEQ ID NO: 5576 - RNA, 27 nt, Artificial Sequence
  Synthetic Oligonucleotide
ucuucccaaaaaugcuuuauuucucuc

SEQ ID NO: 5577 - RNA, 27 nt, Artificial Sequence
  Synthetic Oligonucleotide
acuaaagaugugauuggaaaucuacau

SEQ ID NO: 5578 - RNA, 27 nt, Artificial Sequence
  Synthetic Oligonucleotide
auccuuggauacagcuuccaucuggaa

SEQ ID NO: 5579 - RNA, 27 nt, Artificial Sequence
  Synthetic Oligonucleotide
cucucaaaaugcccuuugcaacaauug

SEQ ID NO: 5580 - RNA, 27 nt, Artificial Sequence
  Synthetic Oligonucleotide
cuuggugacuucucgguccuuguagau

SEQ ID NO: 5581 - RNA, 27 nt, Artificial Sequence
  Synthetic Oligonucleotide
aauucucuccagugcuaccuucucaaa

SEQ ID NO: 5582 - RNA, 27 nt, Artificial Sequence
  Synthetic Oligonucleotide
uuucaccuuaguguuugcuaccuccaa

SEQ ID NO: 5583 - RNA, 27 nt, Artificial Sequence
  Synthetic Oligonucleotide
gcuucuuggugacuucucgguccuugu

SEQ ID NO: 5584 - RNA, 27 nt, Artificial Sequence
  Synthetic Oligonucleotide
cacugucacaaauauggccuuguagcc

SEQ ID NO: 5585 - RNA, 27 nt, Artificial Sequence
  Synthetic Oligonucleotide
ccucaggagaaaaugauaaaguacugg

SEQ ID NO: 5586 - RNA, 27 nt, Artificial Sequence
  Synthetic Oligonucleotide
gacacuaaagaugugauuggaaaucua

SEQ ID NO: 5587 - RNA, 27 nt, Artificial Sequence
  Synthetic Oligonucleotide
ucucuaagaaguaacauacauccuaaa

SEQ ID NO: 5588 - RNA, 27 nt, Artificial Sequence
  Synthetic Oligonucleotide
auuuuccucaggagaaaaugauaaagu

SEQ ID NO: 5589 - RNA, 27 nt, Artificial Sequence
  Synthetic Oligonucleotide
gaaucuguuacgcacaucauccagacg

SEQ ID NO: 5590 - RNA, 27 nt, Artificial Sequence
  Synthetic Oligonucleotide
acuucucgguccuuguagauauacagu

SEQ ID NO: 5591 - RNA, 27 nt, Artificial Sequence
  Synthetic Oligonucleotide
uaucagccaaaguuucuucaucauuug

SEQ ID NO: 5592 - RNA, 27 nt, Artificial Sequence
  Synthetic Oligonucleotide
guccuaaaacagaagucgacagaucug

SEQ ID NO: 5593 - RNA, 27 nt, Artificial Sequence
  Synthetic Oligonucleotide
cauuccaauucucuccagugcuaccuu

SEQ ID NO: 5594 - RNA, 27 nt, Artificial Sequence
  Synthetic Oligonucleotide
uuuccaggaugaaaguccauuucuuuc

SEQ ID NO: 5595 - RNA, 27 nt, Artificial Sequence
  Synthetic Oligonucleotide
agagcuuucagaacaucagugccuuuc

SEQ ID NO: 5596 - RNA, 27 nt, Artificial Sequence
  Synthetic Oligonucleotide
gcaaugaugucagucuucucagccauu

SEQ ID NO: 5597 - RNA, 27 nt, Artificial Sequence
  Synthetic Oligonucleotide
ucuggcagaacaucaauaguggcuggc

SEQ ID NO: 5598 - RNA, 27 nt, Artificial Sequence
  Synthetic Oligonucleotide
ucgguccuuguagauauacaguugcag

SEQ ID NO: 5599 - RNA, 27 nt, Artificial Sequence
  Synthetic Oligonucleotide
ucucgaggacaucuugaacaccuuucu

SEQ ID NO: 5600 - RNA, 27 nt, Artificial Sequence
  Synthetic Oligonucleotide
cuaagaaguaacauacauccuaaaaca

SEQ ID NO: 5601 - RNA, 27 nt, Artificial Sequence
  Synthetic Oligonucleotide
cuuucuaaaagguuccuaggacaccca

SEQ ID NO: 5602 - RNA, 27 nt, Artificial Sequence
  Synthetic Oligonucleotide
uaaaacagaagucgacagaucuguuuc

SEQ ID NO: 5603 - RNA, 27 nt, Artificial Sequence
  Synthetic Oligonucleotide
agucuucucagccauuugauaucuucc

SEQ ID NO: 5604 - RNA, 27 nt, Artificial Sequence
  Synthetic Oligonucleotide
gcuuccaucuggaaaaugcugcaauau

SEQ ID NO: 5605 - RNA, 27 nt, Artificial Sequence
  Synthetic Oligonucleotide
ggaaaagaacgacacccuuuguauuga

SEQ ID NO: 5606 - RNA, 27 nt, Artificial Sequence
  Synthetic Oligonucleotide
guuccuaggacacccauugaaaaguca

SEQ ID NO: 5607 - RNA, 27 nt, Artificial Sequence
  Synthetic Oligonucleotide
ggacacccauugaaaagucaaaagcaa

SEQ ID NO: 5608 - RNA, 27 nt, Artificial Sequence
  Synthetic Oligonucleotide
gaagucgacagaucuguuucagcaaca

SEQ ID NO: 5609 - RNA, 27 nt, Artificial Sequence
  Synthetic Oligonucleotide
cgacagaucuguuucagcaacauuccg

SEQ ID NO: 5610 - RNA, 27 nt, Artificial Sequence
  Synthetic Oligonucleotide
uuacuaaaggauacagcacuuuagccu

SEQ ID NO: 5611 - RNA, 27 nt, Artificial Sequence
  Synthetic Oligonucleotide
uacuaaaggauacagcacuuuagccug

SEQ ID NO: 5612 - RNA, 27 nt, Artificial Sequence
  Synthetic Oligonucleotide
caauucucuccagugcuaccuucucaa

SEQ ID NO: 5613 - RNA, 27 nt, Artificial Sequence
  Synthetic Oligonucleotide
gauagaugggucuauugcuuuagccac

SEQ ID NO: 5614 - RNA, 27 nt, Artificial Sequence
  Synthetic Oligonucleotide
ucucaaaaugcccuuugcaacaauugg

SEQ ID NO: 5615 - RNA, 27 nt, Artificial Sequence
  Synthetic Oligonucleotide
guguuugcuaccuccaauuuuacuaaa

SEQ ID NO: 5616 - RNA, 27 nt, Artificial Sequence
  Synthetic Oligonucleotide
ugacuucucgguccuuguagauauaca

SEQ ID NO: 5617 - RNA, 27 nt, Artificial Sequence
  Synthetic Oligonucleotide
augggucuauugcuuuagccacauaug

SEQ ID NO: 5618 - RNA, 27 nt, Artificial Sequence
  Synthetic Oligonucleotide
caccuuaguguuugcuaccuccaauuu

SEQ ID NO: 5619 - RNA, 27 nt, Artificial Sequence
  Synthetic Oligonucleotide
gugacuucucgguccuuguagauauac

SEQ ID NO: 5620 - RNA, 27 nt, Artificial Sequence
  Synthetic Oligonucleotide
uuagccacauaugcagcaaguccacug

SEQ ID NO: 5621 - RNA, 27 nt, Artificial Sequence
  Synthetic Oligonucleotide
cuaccuccaauuuuacuaaaggauaca

SEQ ID NO: 5622 - RNA, 27 nt, Artificial Sequence
  Synthetic Oligonucleotide
cugcacagugucucuuugucaaguaau

SEQ ID NO: 5623 - RNA, 27 nt, Artificial Sequence
  Synthetic Oligonucleotide
uuccuaggacacccauugaaaagucaa

SEQ ID NO: 5624 - RNA, 27 nt, Artificial Sequence
  Synthetic Oligonucleotide
aggaugaaaguccauuucuuucuaaaa

SEQ ID NO: 5625 - RNA, 27 nt, Artificial Sequence
  Synthetic Oligonucleotide
cuguuucagcaacauuccggagcaucc

SEQ ID NO: 5626 - RNA, 27 nt, Artificial Sequence
  Synthetic Oligonucleotide
uccaggaugaaaguccauuucuuucua

SEQ ID NO: 5627 - RNA, 27 nt, Artificial Sequence
  Synthetic Oligonucleotide
aaccacuguuuuaaagacauguaaaca

SEQ ID NO: 5628 - RNA, 27 nt, Artificial Sequence
  Synthetic Oligonucleotide
auuaucagccaaaguuucuucaucauu

SEQ ID NO: 5629 - RNA, 27 nt, Artificial Sequence
  Synthetic Oligonucleotide
acauaugcagcaaguccacugucgucu

SEQ ID NO: 5630 - RNA, 27 nt, Artificial Sequence
  Synthetic Oligonucleotide
uccuaaaacagaagucgacagaucugu

SEQ ID NO: 5631 - RNA, 27 nt, Artificial Sequence
  Synthetic Oligonucleotide
gaugggucuauugcuuuagccacauau

SEQ ID NO: 5632 - RNA, 27 nt, Artificial Sequence
  Synthetic Oligonucleotide
cuuucagaacaucagugccuuuccgca

SEQ ID NO: 5633 - RNA, 27 nt, Artificial Sequence
  Synthetic Oligonucleotide
gucuauugcuuuagccacauaugcagc

SEQ ID NO: 5634 - RNA, 27 nt, Artificial Sequence
  Synthetic Oligonucleotide
uaugcagcaaguccacugucgucucca

SEQ ID NO: 5635 - RNA, 27 nt, Artificial Sequence
  Synthetic Oligonucleotide
auuacagacuguggucacccucugcac

SEQ ID NO: 5636 - RNA, 27 nt, Artificial Sequence
  Synthetic Oligonucleotide
cauuuggauauauucagacacuaaaga

SEQ ID NO: 5637 - RNA, 27 nt, Artificial Sequence
  Synthetic Oligonucleotide
cuuuaguaucucgaggacaucuugaac

SEQ ID NO: 5638 - RNA, 27 nt, Artificial Sequence
  Synthetic Oligonucleotide
uuaguguuugcuaccuccaauuuuacu

SEQ ID NO: 5639 - RNA, 27 nt, Artificial Sequence
  Synthetic Oligonucleotide
cagugcuaccuucucaaaguugugaau

SEQ ID NO: 5640 - RNA, 27 nt, Artificial Sequence
  Synthetic Oligonucleotide
ugucagucuucucagccauuugauauc

SEQ ID NO: 5641 - RNA, 27 nt, Artificial Sequence
  Synthetic Oligonucleotide
ucgaggacaucuugaacaccuuucucc

SEQ ID NO: 5642 - RNA, 27 nt, Artificial Sequence
  Synthetic Oligonucleotide
acacuaaagaugugauuggaaaucuac

SEQ ID NO: 5643 - RNA, 27 nt, Artificial Sequence
  Synthetic Oligonucleotide
gaugugauuggaaaucuacauucaaag

SEQ ID NO: 5644 - RNA, 27 nt, Artificial Sequence
  Synthetic Oligonucleotide
agcuuccaucuggaaaaugcugcaaua

SEQ ID NO: 5645 - RNA, 27 nt, Artificial Sequence
  Synthetic Oligonucleotide
aacgacacccuuuguauugaagugggg

SEQ ID NO: 5646 - RNA, 27 nt, Artificial Sequence
  Synthetic Oligonucleotide
ugauuggaaaucuacauucaaagaagu

SEQ ID NO: 5647 - RNA, 27 nt, Artificial Sequence
  Synthetic Oligonucleotide
auugcuuuagccacauaugcagcaagu

SEQ ID NO: 5648 - RNA, 27 nt, Artificial Sequence
  Synthetic Oligonucleotide
uucuaaaagguuccuaggacacccauu

SEQ ID NO: 5649 - RNA, 27 nt, Artificial Sequence
  Synthetic Oligonucleotide
cugauagaugggucuauugcuuuagcc

SEQ ID NO: 5650 - RNA, 27 nt, Artificial Sequence
  Synthetic Oligonucleotide
accggaauucuuccuuuaguaucucga

SEQ ID NO: 5651 - RNA, 27 nt, Artificial Sequence
  Synthetic Oligonucleotide
uucagaacaucagugccuuuccgcaca

SEQ ID NO: 5652 - RNA, 27 nt, Artificial Sequence
  Synthetic Oligonucleotide
cucuaagaaguaacauacauccuaaaa

SEQ ID NO: 5653 - RNA, 27 nt, Artificial Sequence
  Synthetic Oligonucleotide
uccacugucgucuccaaaauuuuccuc

SEQ ID NO: 5654 - RNA, 27 nt, Artificial Sequence
  Synthetic Oligonucleotide
guuugcuaccuccaauuuuacuaaagg

SEQ ID NO: 5655 - RNA, 27 nt, Artificial Sequence
  Synthetic Oligonucleotide
cauauuggcaugcugacccucuguccu

SEQ ID NO: 5656 - RNA, 27 nt, Artificial Sequence
  Synthetic Oligonucleotide
cucuguccuaaaacagaagucgacaga

SEQ ID NO: 5657 - RNA, 27 nt, Artificial Sequence
  Synthetic Oligonucleotide
ucuaagaaguaacauacauccuaaaac

SEQ ID NO: 5658 - RNA, 27 nt, Artificial Sequence
  Synthetic Oligonucleotide
acccauuccaauucucuccagugcuac

SEQ ID NO: 5659 - RNA, 27 nt, Artificial Sequence
  Synthetic Oligonucleotide
accuuaguguuugcuaccuccaauuuu

SEQ ID NO: 5660 - RNA, 27 nt, Artificial Sequence
  Synthetic Oligonucleotide
ggcaaugaugucagucuucucagccau

SEQ ID NO: 5661 - RNA, 27 nt, Artificial Sequence
  Synthetic Oligonucleotide
uucagacacuaaagaugugauuggaaa

SEQ ID NO: 5662 - RNA, 27 nt, Artificial Sequence
  Synthetic Oligonucleotide
aaagaacgacacccuuuguauugaagu

SEQ ID NO: 5663 - RNA, 27 nt, Artificial Sequence
  Synthetic Oligonucleotide
gacuucucgguccuuguagauauacag

SEQ ID NO: 5664 - RNA, 27 nt, Artificial Sequence
  Synthetic Oligonucleotide
ugcuuuagccacauaugcagcaagucc

SEQ ID NO: 5665 - RNA, 27 nt, Artificial Sequence
  Synthetic Oligonucleotide
augcugcaauauuaucagccaaaguuu

SEQ ID NO: 5666 - RNA, 27 nt, Artificial Sequence
  Synthetic Oligonucleotide
gcaaguccacugucgucuccaaaauuu

SEQ ID NO: 5667 - RNA, 27 nt, Artificial Sequence
  Synthetic Oligonucleotide
ucuguccuaaaacagaagucgacagau

SEQ ID NO: 5668 - RNA, 27 nt, Artificial Sequence
  Synthetic Oligonucleotide
aaaguuucuucaucauuugccccagac

SEQ ID NO: 5669 - RNA, 27 nt, Artificial Sequence
  Synthetic Oligonucleotide
ucgucuccaaaauuuuccucaggagaa

SEQ ID NO: 5670 - RNA, 27 nt, Artificial Sequence
  Synthetic Oligonucleotide
auagaugggucuauugcuuuagccaca

SEQ ID NO: 5671 - RNA, 27 nt, Artificial Sequence
  Synthetic Oligonucleotide
cacauauuggcaugcugacccucuguc

SEQ ID NO: 5672 - RNA, 27 nt, Artificial Sequence
  Synthetic Oligonucleotide
cuaggacacccauugaaaagucaaaag

SEQ ID NO: 5673 - RNA, 27 nt, Artificial Sequence
  Synthetic Oligonucleotide
agcuuucagaacaucagugccuuuccg

SEQ ID NO: 5674 - RNA, 27 nt, Artificial Sequence
  Synthetic Oligonucleotide
uugaaguggggaauuacagacuguggu

SEQ ID NO: 5675 - RNA, 27 nt, Artificial Sequence
  Synthetic Oligonucleotide
aaaaugcugcaauauuaucagccaaag

SEQ ID NO: 5676 - RNA, 27 nt, Artificial Sequence
  Synthetic Oligonucleotide
aaguccauuucuuucuaaaagguuccu

SEQ ID NO: 5677 - RNA, 27 nt, Artificial Sequence
  Synthetic Oligonucleotide
gaauucuuccuuuaguaucucgaggac

SEQ ID NO: 5678 - RNA, 27 nt, Artificial Sequence
  Synthetic Oligonucleotide
aaccggaauucuuccuuuaguaucucg

SEQ ID NO: 5679 - RNA, 27 nt, Artificial Sequence
  Synthetic Oligonucleotide
uugauaucuucccagcugauagauggg

SEQ ID NO: 5680 - RNA, 27 nt, Artificial Sequence
  Synthetic Oligonucleotide
acagaagucgacagaucuguuucagca

SEQ ID NO: 5681 - RNA, 27 nt, Artificial Sequence
  Synthetic Oligonucleotide
uguuugcuaccuccaauuuuacuaaag

SEQ ID NO: 5682 - RNA, 27 nt, Artificial Sequence
  Synthetic Oligonucleotide
uguggucacccucugcacagugucucu

SEQ ID NO: 5683 - RNA, 27 nt, Artificial Sequence
  Synthetic Oligonucleotide
uugcuaccuccaauuuuacuaaaggau

SEQ ID NO: 5684 - RNA, 27 nt, Artificial Sequence
  Synthetic Oligonucleotide
auacagcuuccaucuggaaaaugcugc

SEQ ID NO: 5685 - RNA, 27 nt, Artificial Sequence
  Synthetic Oligonucleotide
cuucucgguccuuguagauauacaguu

SEQ ID NO: 5686 - RNA, 27 nt, Artificial Sequence
  Synthetic Oligonucleotide
uaggacacccauugaaaagucaaaagc

SEQ ID NO: 5687 - RNA, 27 nt, Artificial Sequence
  Synthetic Oligonucleotide
uuuuacuaaaggauacagcacuuuagc

SEQ ID NO: 5688 - RNA, 27 nt, Artificial Sequence
  Synthetic Oligonucleotide
cauuucuuucuaaaagguuccuaggac

SEQ ID NO: 5689 - RNA, 27 nt, Artificial Sequence
  Synthetic Oligonucleotide
uggucacccucugcacagugucucuuu

SEQ ID NO: 5690 - RNA, 27 nt, Artificial Sequence
  Synthetic Oligonucleotide
uuucuaaaagguuccuaggacacccau

SEQ ID NO: 5691 - RNA, 27 nt, Artificial Sequence
  Synthetic Oligonucleotide
auaucuucccagcugauagaugggucu

SEQ ID NO: 5692 - RNA, 27 nt, Artificial Sequence
  Synthetic Oligonucleotide
ucuccaaaauuuuccucaggagaaaau

SEQ ID NO: 5693 - RNA, 27 nt, Artificial Sequence
  Synthetic Oligonucleotide
cagcugauagaugggucuauugcuuua

SEQ ID NO: 5694 - RNA, 27 nt, Artificial Sequence
  Synthetic Oligonucleotide
gaacaucaauaguggcuggcaccccau

SEQ ID NO: 5695 - RNA, 27 nt, Artificial Sequence
  Synthetic Oligonucleotide
aaacagaagucgacagaucuguuucag

SEQ ID NO: 5696 - RNA, 27 nt, Artificial Sequence
  Synthetic Oligonucleotide
acgacacccuuuguauugaagugggga

SEQ ID NO: 5697 - RNA, 27 nt, Artificial Sequence
  Synthetic Oligonucleotide
gaaccacuguuuuaaagacauguaaac

SEQ ID NO: 5698 - RNA, 27 nt, Artificial Sequence
  Synthetic Oligonucleotide
ccaauucucuccagugcuaccuucuca

SEQ ID NO: 5699 - RNA, 27 nt, Artificial Sequence
  Synthetic Oligonucleotide
aacauuccggagcauccuuggauacag

SEQ ID NO: 5700 - RNA, 27 nt, Artificial Sequence
  Synthetic Oligonucleotide
ucaucaccucucaaaaugcccuuugca

SEQ ID NO: 5701 - RNA, 27 nt, Artificial Sequence
  Synthetic Oligonucleotide
agaaguaucaccaauuaccgccaccca

SEQ ID NO: 5702 - RNA, 27 nt, Artificial Sequence
  Synthetic Oligonucleotide
cucaaaaugcccuuugcaacaauuggc

SEQ ID NO: 5703 - RNA, 27 nt, Artificial Sequence
  Synthetic Oligonucleotide
cuaaagaugugauuggaaaucuacauu

SEQ ID NO: 5704 - RNA, 27 nt, Artificial Sequence
  Synthetic Oligonucleotide
cacccucugcacagugucucuuuguca

SEQ ID NO: 5705 - RNA, 27 nt, Artificial Sequence
  Synthetic Oligonucleotide
cagaagucgacagaucuguuucagcaa

SEQ ID NO: 5706 - RNA, 27 nt, Artificial Sequence
  Synthetic Oligonucleotide
cugucgucuccaaaauuuuccucagga

SEQ ID NO: 5707 - RNA, 27 nt, Artificial Sequence
  Synthetic Oligonucleotide
cccaaaaaugcuuuauuucucucuaag

SEQ ID NO: 5708 - RNA, 27 nt, Artificial Sequence
  Synthetic Oligonucleotide
ugauagaugggucuauugcuuuagcca

SEQ ID NO: 5709 - RNA, 27 nt, Artificial Sequence
  Synthetic Oligonucleotide
ccauuucuuucuaaaagguuccuagga

SEQ ID NO: 5710 - RNA, 27 nt, Artificial Sequence
  Synthetic Oligonucleotide
gcccuuugcaacaauuggcaaugaugu

SEQ ID NO: 5711 - RNA, 27 nt, Artificial Sequence
  Synthetic Oligonucleotide
gcauccuuggauacagcuuccaucugg

SEQ ID NO: 5712 - RNA, 27 nt, Artificial Sequence
  Synthetic Oligonucleotide
uacagacuguggucacccucugcacag

SEQ ID NO: 5713 - RNA, 27 nt, Artificial Sequence
  Synthetic Oligonucleotide
gagcauccuuggauacagcuuccaucu

SEQ ID NO: 5714 - RNA, 27 nt, Artificial Sequence
  Synthetic Oligonucleotide
ugcccuuugcaacaauuggcaaugaug

SEQ ID NO: 5715 - RNA, 27 nt, Artificial Sequence
  Synthetic Oligonucleotide
ccucaccaaugucuugucgaugacuuu

SEQ ID NO: 5716 - RNA, 27 nt, Artificial Sequence
  Synthetic Oligonucleotide
uagaugggucuauugcuuuagccacau

SEQ ID NO: 5717 - RNA, 27 nt, Artificial Sequence
  Synthetic Oligonucleotide
aaucuguuacgcacaucauccagacgg

SEQ ID NO: 5718 - RNA, 27 nt, Artificial Sequence
  Synthetic Oligonucleotide
gaucuguuucagcaacauuccggagca

SEQ ID NO: 5719 - RNA, 27 nt, Artificial Sequence
  Synthetic Oligonucleotide
aaaagggauugcuauuuuguuggaaaa

SEQ ID NO: 5720 - RNA, 27 nt, Artificial Sequence
  Synthetic Oligonucleotide
ggaugaaaguccauuucuuucuaaaag

SEQ ID NO: 5721 - RNA, 27 nt, Artificial Sequence
  Synthetic Oligonucleotide
gcuuucagaacaucagugccuuuccgc

SEQ ID NO: 5722 - RNA, 27 nt, Artificial Sequence
  Synthetic Oligonucleotide
aucucgaggacaucuugaacaccuuuc

SEQ ID NO: 5723 - RNA, 27 nt, Artificial Sequence
  Synthetic Oligonucleotide
cucgaggacaucuugaacaccuuucuc

SEQ ID NO: 5724 - RNA, 27 nt, Artificial Sequence
  Synthetic Oligonucleotide
accucucaaaaugcccuuugcaacaau

SEQ ID NO: 5725 - RNA, 27 nt, Artificial Sequence
  Synthetic Oligonucleotide
ggauugcuauuuuguuggaaaagaacg

SEQ ID NO: 5726 - RNA, 27 nt, Artificial Sequence
  Synthetic Oligonucleotide
agaacgacacccuuuguauugaagugg

SEQ ID NO: 5727 - RNA, 27 nt, Artificial Sequence
  Synthetic Oligonucleotide
auauugugcacugucagaucuuggaaa

SEQ ID NO: 5728 - RNA, 27 nt, Artificial Sequence
  Synthetic Oligonucleotide
aagaacgacacccuuuguauugaagug

SEQ ID NO: 5729 - RNA, 27 nt, Artificial Sequence
  Synthetic Oligonucleotide
uucucuccagugcuaccuucucaaagu

SEQ ID NO: 5730 - RNA, 27 nt, Artificial Sequence
  Synthetic Oligonucleotide
auuuuucauccugaguuguggcggcag

SEQ ID NO: 5731 - RNA, 27 nt, Artificial Sequence
  Synthetic Oligonucleotide
agaagucgacagaucuguuucagcaac

SEQ ID NO: 5732 - RNA, 27 nt, Artificial Sequence
  Synthetic Oligonucleotide
aaaguccauuucuuucuaaaagguucc

SEQ ID NO: 5733 - RNA, 27 nt, Artificial Sequence
  Synthetic Oligonucleotide
uuuaagaaccacuguuuuaaagacaug

SEQ ID NO: 5734 - RNA, 27 nt, Artificial Sequence
  Synthetic Oligonucleotide
cuccacaauuucuggcagaacaucaau

SEQ ID NO: 5735 - RNA, 27 nt, Artificial Sequence
  Synthetic Oligonucleotide
cagaacaucaauaguggcuggcacccc

SEQ ID NO: 5736 - RNA, 27 nt, Artificial Sequence
  Synthetic Oligonucleotide
cauaugcagcaaguccacugucgucuc

SEQ ID NO: 5737 - RNA, 27 nt, Artificial Sequence
  Synthetic Oligonucleotide
ucaccucucaaaaugcccuuugcaaca

SEQ ID NO: 5738 - RNA, 27 nt, Artificial Sequence
  Synthetic Oligonucleotide
uagcuucuuggugacuucucgguccuu

SEQ ID NO: 5739 - RNA, 27 nt, Artificial Sequence
  Synthetic Oligonucleotide
cagaucuguuucagcaacauuccggag

SEQ ID NO: 5740 - RNA, 27 nt, Artificial Sequence
  Synthetic Oligonucleotide
guuucuucaucauuugccccagaccug

SEQ ID NO: 5741 - RNA, 27 nt, Artificial Sequence
  Synthetic Oligonucleotide
uggcagaacaucaauaguggcuggcac

SEQ ID NO: 5742 - RNA, 27 nt, Artificial Sequence
  Synthetic Oligonucleotide
uuucagaacaucagugccuuuccgcac

SEQ ID NO: 5743 - RNA, 27 nt, Artificial Sequence
  Synthetic Oligonucleotide
uauugcuuuagccacauaugcagcaag

SEQ ID NO: 5744 - RNA, 27 nt, Artificial Sequence
  Synthetic Oligonucleotide
cuucucagccauuugauaucuucccag

SEQ ID NO: 5745 - RNA, 27 nt, Artificial Sequence
  Synthetic Oligonucleotide
uucuuucuaaaagguuccuaggacacc

SEQ ID NO: 5746 - RNA, 27 nt, Artificial Sequence
  Synthetic Oligonucleotide
ccggaauucuuccuuuaguaucucgag

SEQ ID NO: 5747 - RNA, 27 nt, Artificial Sequence
  Synthetic Oligonucleotide
cugucacaaauauggccuuguagccca

SEQ ID NO: 5748 - RNA, 27 nt, Artificial Sequence
  Synthetic Oligonucleotide
ccagugcuaccuucucaaaguugugaa

SEQ ID NO: 5749 - RNA, 27 nt, Artificial Sequence
  Synthetic Oligonucleotide
gauauacaguugcagccaacgaagugc

SEQ ID NO: 5750 - RNA, 27 nt, Artificial Sequence
  Synthetic Oligonucleotide
gccuccacaauuucuggcagaacauca

SEQ ID NO: 5751 - RNA, 27 nt, Artificial Sequence
  Synthetic Oligonucleotide
cacuaaagaugugauuggaaaucuaca

SEQ ID NO: 5752 - RNA, 27 nt, Artificial Sequence
  Synthetic Oligonucleotide
gcuuuagccacauaugcagcaagucca

SEQ ID NO: 5753 - RNA, 27 nt, Artificial Sequence
  Synthetic Oligonucleotide
ggauacagcuuccaucuggaaaaugcu

SEQ ID NO: 5754 - RNA, 27 nt, Artificial Sequence
  Synthetic Oligonucleotide
ccaaaggauuuuuccucaccaaugucu

SEQ ID NO: 5755 - RNA, 27 nt, Artificial Sequence
  Synthetic Oligonucleotide
ggcagaacaucaauaguggcuggcacc

SEQ ID NO: 5756 - RNA, 27 nt, Artificial Sequence
  Synthetic Oligonucleotide
cuucuuggugacuucucgguccuugua

SEQ ID NO: 5757 - RNA, 27 nt, Artificial Sequence
  Synthetic Oligonucleotide
guguccacugucacaaauauggccuug

SEQ ID NO: 5758 - RNA, 27 nt, Artificial Sequence
  Synthetic Oligonucleotide
aaagaaguaucaccaauuaccgccacc

SEQ ID NO: 5759 - RNA, 27 nt, Artificial Sequence
  Synthetic Oligonucleotide
caacauuccggagcauccuuggauaca

SEQ ID NO: 5760 - RNA, 27 nt, Artificial Sequence
  Synthetic Oligonucleotide
agcauccuuggauacagcuuccaucug

SEQ ID NO: 5761 - RNA, 27 nt, Artificial Sequence
  Synthetic Oligonucleotide
cuaaaagguuccuaggacacccauuga

SEQ ID NO: 5762 - RNA, 27 nt, Artificial Sequence
  Synthetic Oligonucleotide
ucuccagugcuaccuucucaaaguugu

SEQ ID NO: 5763 - RNA, 27 nt, Artificial Sequence
  Synthetic Oligonucleotide
aagaaccacuguuuuaaagacauguaa

SEQ ID NO: 5764 - RNA, 27 nt, Artificial Sequence
  Synthetic Oligonucleotide
aaguaucaccaauuaccgccacccauu

SEQ ID NO: 5765 - RNA, 27 nt, Artificial Sequence
  Synthetic Oligonucleotide
aaagguuccuaggacacccauugaaaa

SEQ ID NO: 5766 - RNA, 27 nt, Artificial Sequence
  Synthetic Oligonucleotide
cccucugcacagugucucuuugucaag

SEQ ID NO: 5767 - RNA, 27 nt, Artificial Sequence
  Synthetic Oligonucleotide
uuccaggaugaaaguccauuucuuucu

SEQ ID NO: 5768 - RNA, 27 nt, Artificial Sequence
  Synthetic Oligonucleotide
accuccaauuuuacuaaaggauacagc

SEQ ID NO: 5769 - RNA, 27 nt, Artificial Sequence
  Synthetic Oligonucleotide
gccauuugauaucuucccagcugauag

SEQ ID NO: 5770 - RNA, 27 nt, Artificial Sequence
  Synthetic Oligonucleotide
gcagaacaucaauaguggcuggcaccc

SEQ ID NO: 5771 - RNA, 27 nt, Artificial Sequence
  Synthetic Oligonucleotide
uucuucaucauuugccccagaccugua

SEQ ID NO: 5772 - RNA, 27 nt, Artificial Sequence
  Synthetic Oligonucleotide
cgaugacuuucacauucuggcacccac

SEQ ID NO: 5773 - RNA, 27 nt, Artificial Sequence
  Synthetic Oligonucleotide
ggagcauccuuggauacagcuuccauc

SEQ ID NO: 5774 - RNA, 27 nt, Artificial Sequence
  Synthetic Oligonucleotide
acuuucacauucuggcacccacucaga

SEQ ID NO: 5775 - RNA, 27 nt, Artificial Sequence
  Synthetic Oligonucleotide
cuuggauacagcuuccaucuggaaaau

SEQ ID NO: 5776 - RNA, 27 nt, Artificial Sequence
  Synthetic Oligonucleotide
uggugacuucucgguccuuguagauau

SEQ ID NO: 5777 - RNA, 27 nt, Artificial Sequence
  Synthetic Oligonucleotide
ccacugucgucuccaaaauuuuccuca

SEQ ID NO: 5778 - RNA, 27 nt, Artificial Sequence
  Synthetic Oligonucleotide
ggggaauuacagacuguggucacccuc

SEQ ID NO: 5779 - RNA, 27 nt, Artificial Sequence
  Synthetic Oligonucleotide
acccucugcacagugucucuuugucaa

SEQ ID NO: 5780 - RNA, 27 nt, Artificial Sequence
  Synthetic Oligonucleotide
uaucucgaggacaucuugaacaccuuu

SEQ ID NO: 5781 - RNA, 27 nt, Artificial Sequence
  Synthetic Oligonucleotide
cacccauuccaauucucuccagugcua

SEQ ID NO: 5782 - RNA, 27 nt, Artificial Sequence
  Synthetic Oligonucleotide
agaaccacuguuuuaaagacauguaaa

SEQ ID NO: 5783 - RNA, 27 nt, Artificial Sequence
  Synthetic Oligonucleotide
cgcacuagcuucuuggugacuucucgg

SEQ ID NO: 5784 - RNA, 27 nt, Artificial Sequence
  Synthetic Oligonucleotide
cagaccuguaauagucauauauagacu

SEQ ID NO: 5785 - RNA, 27 nt, Artificial Sequence
  Synthetic Oligonucleotide
ccagaccuguaauagucauauauagac

SEQ ID NO: 5786 - RNA, 27 nt, Artificial Sequence
  Synthetic Oligonucleotide
aucaucaccucucaaaaugcccuuugc

SEQ ID NO: 5787 - RNA, 27 nt, Artificial Sequence
  Synthetic Oligonucleotide
gucuucucagccauuugauaucuuccc

SEQ ID NO: 5788 - RNA, 27 nt, Artificial Sequence
  Synthetic Oligonucleotide
ugaguuguggcggcaguuugaaucugu

SEQ ID NO: 5789 - RNA, 27 nt, Artificial Sequence
  Synthetic Oligonucleotide
uguuucagcaacauuccggagcauccu

SEQ ID NO: 5790 - RNA, 27 nt, Artificial Sequence
  Synthetic Oligonucleotide
acugucgucuccaaaauuuuccucagg

SEQ ID NO: 5791 - RNA, 27 nt, Artificial Sequence
  Synthetic Oligonucleotide
uucuuggugacuucucgguccuuguag

SEQ ID NO: 5792 - RNA, 27 nt, Artificial Sequence
  Synthetic Oligonucleotide
aucagccaaaguuucuucaucauuugc

SEQ ID NO: 5793 - RNA, 27 nt, Artificial Sequence
  Synthetic Oligonucleotide
cagagcuuucagaacaucagugccuuu

SEQ ID NO: 5794 - RNA, 27 nt, Artificial Sequence
  Synthetic Oligonucleotide
ucagccaaaguuucuucaucauuugcc

SEQ ID NO: 5795 - RNA, 27 nt, Artificial Sequence
  Synthetic Oligonucleotide
gaaguaucaccaauuaccgccacccau

SEQ ID NO: 5796 - RNA, 27 nt, Artificial Sequence
  Synthetic Oligonucleotide
caaaguuucuucaucauuugccccaga

SEQ ID NO: 5797 - RNA, 27 nt, Artificial Sequence
  Synthetic Oligonucleotide
aguaucaccaauuaccgccacccauuc

SEQ ID NO: 5798 - RNA, 27 nt, Artificial Sequence
  Synthetic Oligonucleotide
ccucuguccuaaaacagaagucgacag

SEQ ID NO: 5799 - RNA, 27 nt, Artificial Sequence
  Synthetic Oligonucleotide
cgguccuuguagauauacaguugcagc

SEQ ID NO: 5800 - RNA, 27 nt, Artificial Sequence
  Synthetic Oligonucleotide
ugggucuauugcuuuagccacauaugc

SEQ ID NO: 5801 - RNA, 27 nt, Artificial Sequence
  Synthetic Oligonucleotide
uuuucauccugaguuguggcggcaguu

SEQ ID NO: 5802 - RNA, 27 nt, Artificial Sequence
  Synthetic Oligonucleotide
ccauuugauaucuucccagcugauaga

SEQ ID NO: 5803 - RNA, 27 nt, Artificial Sequence
  Synthetic Oligonucleotide
ccuuaguguuugcuaccuccaauuuua

SEQ ID NO: 5804 - RNA, 27 nt, Artificial Sequence
  Synthetic Oligonucleotide
gccaaaggauuuuuccucaccaauguc

SEQ ID NO: 5805 - RNA, 27 nt, Artificial Sequence
  Synthetic Oligonucleotide
gucacccucugcacagugucucuuugu

SEQ ID NO: 5806 - RNA, 27 nt, Artificial Sequence
  Synthetic Oligonucleotide
gaaguggggaauuacagacugugguca

SEQ ID NO: 5807 - RNA, 27 nt, Artificial Sequence
  Synthetic Oligonucleotide
cgaggacaucuugaacaccuuucuccc

SEQ ID NO: 5808 - RNA, 27 nt, Artificial Sequence
  Synthetic Oligonucleotide
auucucuccagugcuaccuucucaaag

SEQ ID NO: 5809 - RNA, 27 nt, Artificial Sequence
  Synthetic Oligonucleotide
gcaucaucaccucucaaaaugcccuuu

SEQ ID NO: 5810 - RNA, 27 nt, Artificial Sequence
  Synthetic Oligonucleotide
ucuucaucauuugccccagaccuguaa

SEQ ID NO: 5811 - RNA, 27 nt, Artificial Sequence
  Synthetic Oligonucleotide
cuccaaaauuuuccucaggagaaaaug

SEQ ID NO: 5812 - RNA, 27 nt, Artificial Sequence
  Synthetic Oligonucleotide
gcuaccuccaauuuuacuaaaggauac

SEQ ID NO: 5813 - RNA, 27 nt, Artificial Sequence
  Synthetic Oligonucleotide
cauuugauaucuucccagcugauagau

SEQ ID NO: 5814 - RNA, 27 nt, Artificial Sequence
  Synthetic Oligonucleotide
acuucuucaauugaggagguggcccag

SEQ ID NO: 5815 - RNA, 27 nt, Artificial Sequence
  Synthetic Oligonucleotide
ucuuggugacuucucgguccuuguaga

SEQ ID NO: 5816 - RNA, 27 nt, Artificial Sequence
  Synthetic Oligonucleotide
guaucaccaauuaccgccacccauucc

SEQ ID NO: 5817 - RNA, 27 nt, Artificial Sequence
  Synthetic Oligonucleotide
acugucacaaauauggccuuguagccc

SEQ ID NO: 5818 - RNA, 27 nt, Artificial Sequence
  Synthetic Oligonucleotide
gucuccaaaauuuuccucaggagaaaa

SEQ ID NO: 5819 - RNA, 27 nt, Artificial Sequence
  Synthetic Oligonucleotide
cuagcuucuuggugacuucucgguccu

SEQ ID NO: 5820 - RNA, 27 nt, Artificial Sequence
  Synthetic Oligonucleotide
ucuuucuaaaagguuccuaggacaccc

SEQ ID NO: 5821 - RNA, 27 nt, Artificial Sequence
  Synthetic Oligonucleotide
gcacuagcuucuuggugacuucucggu

SEQ ID NO: 5822 - RNA, 27 nt, Artificial Sequence
  Synthetic Oligonucleotide
cggaauucuuccuuuaguaucucgagg

SEQ ID NO: 5823 - RNA, 27 nt, Artificial Sequence
  Synthetic Oligonucleotide
auaugcagcaaguccacugucgucucc

SEQ ID NO: 5824 - RNA, 27 nt, Artificial Sequence
  Synthetic Oligonucleotide
uaucuucccagcugauagaugggucua

SEQ ID NO: 5825 - RNA, 27 nt, Artificial Sequence
  Synthetic Oligonucleotide
cuuucacauucuggcacccacucagag

SEQ ID NO: 5826 - RNA, 27 nt, Artificial Sequence
  Synthetic Oligonucleotide
ucacccucugcacagugucucuuuguc

SEQ ID NO: 5827 - RNA, 27 nt, Artificial Sequence
  Synthetic Oligonucleotide
cuauugcuuuagccacauaugcagcaa

SEQ ID NO: 5828 - RNA, 27 nt, Artificial Sequence
  Synthetic Oligonucleotide
aaaaugcuuuauuucucucuaagaagu

SEQ ID NO: 5829 - RNA, 27 nt, Artificial Sequence
  Synthetic Oligonucleotide
uaaaagguuccuaggacacccauugaa

SEQ ID NO: 5830 - RNA, 27 nt, Artificial Sequence
  Synthetic Oligonucleotide
ugauaucuucccagcugauagaugggu

SEQ ID NO: 5831 - RNA, 27 nt, Artificial Sequence
  Synthetic Oligonucleotide
cccagaccuguaauagucauauauaga

SEQ ID NO: 5832 - RNA, 27 nt, Artificial Sequence
  Synthetic Oligonucleotide
uuucuucaucauuugccccagaccugu

SEQ ID NO: 5833 - RNA, 27 nt, Artificial Sequence
  Synthetic Oligonucleotide
cuucccagcugauagaugggucuauug

SEQ ID NO: 5834 - RNA, 27 nt, Artificial Sequence
  Synthetic Oligonucleotide
aaaaugcccuuugcaacaauuggcaau

SEQ ID NO: 5835 - RNA, 27 nt, Artificial Sequence
  Synthetic Oligonucleotide
ucuuccuuuaguaucucgaggacaucu

SEQ ID NO: 5836 - RNA, 27 nt, Artificial Sequence
  Synthetic Oligonucleotide
caccucucaaaaugcccuuugcaacaa

SEQ ID NO: 5837 - RNA, 27 nt, Artificial Sequence
  Synthetic Oligonucleotide
ucagaacaucagugccuuuccgcacac

SEQ ID NO: 5838 - RNA, 27 nt, Artificial Sequence
  Synthetic Oligonucleotide
agaucuguuucagcaacauuccggagc

SEQ ID NO: 5839 - RNA, 27 nt, Artificial Sequence
  Synthetic Oligonucleotide
ccauuccaauucucuccagugcuaccu

SEQ ID NO: 5840 - RNA, 27 nt, Artificial Sequence
  Synthetic Oligonucleotide
gccacauaugcagcaaguccacugucg

SEQ ID NO: 5841 - RNA, 27 nt, Artificial Sequence
  Synthetic Oligonucleotide
uagccacauaugcagcaaguccacugu

SEQ ID NO: 5842 - RNA, 27 nt, Artificial Sequence
  Synthetic Oligonucleotide
uacaguugcagccaacgaagugccuca

SEQ ID NO: 5843 - RNA, 27 nt, Artificial Sequence
  Synthetic Oligonucleotide
ucagacacuaaagaugugauuggaaau

SEQ ID NO: 5844 - RNA, 27 nt, Artificial Sequence
  Synthetic Oligonucleotide
agcaaguccacugucgucuccaaaauu

SEQ ID NO: 5845 - RNA, 27 nt, Artificial Sequence
  Synthetic Oligonucleotide
ugcuaccuccaauuuuacuaaaggaua

SEQ ID NO: 5846 - RNA, 27 nt, Artificial Sequence
  Synthetic Oligonucleotide
ugauucgacaccaagaucccauucaag

SEQ ID NO: 5847 - RNA, 27 nt, Artificial Sequence
  Synthetic Oligonucleotide
gagccagagcuuucagaacaucagugc

SEQ ID NO: 5848 - RNA, 27 nt, Artificial Sequence
  Synthetic Oligonucleotide
acugacaggcucucacaguggcaagcu

SEQ ID NO: 5849 - RNA, 27 nt, Artificial Sequence
  Synthetic Oligonucleotide
aguccacugucgucuccaaaauuuucc

SEQ ID NO: 5850 - RNA, 27 nt, Artificial Sequence
  Synthetic Oligonucleotide
guggggaauuacagacuguggucaccc

SEQ ID NO: 5851 - RNA, 27 nt, Artificial Sequence
  Synthetic Oligonucleotide
auauuggcaugcugacccucuguccua

SEQ ID NO: 5852 - RNA, 27 nt, Artificial Sequence
  Synthetic Oligonucleotide
aagaaguaucaccaauuaccgccaccc

SEQ ID NO: 5853 - RNA, 27 nt, Artificial Sequence
  Synthetic Oligonucleotide
cuggcaucaucaccucucaaaaugccc

SEQ ID NO: 5854 - RNA, 27 nt, Artificial Sequence
  Synthetic Oligonucleotide
cggagcauccuuggauacagcuuccau

SEQ ID NO: 5855 - RNA, 27 nt, Artificial Sequence
  Synthetic Oligonucleotide
cccauuccaauucucuccagugcuacc

SEQ ID NO: 5856 - RNA, 27 nt, Artificial Sequence
  Synthetic Oligonucleotide
acuagcuucuuggugacuucucggucc

SEQ ID NO: 5857 - RNA, 27 nt, Artificial Sequence
  Synthetic Oligonucleotide
gauaucuucccagcugauagauggguc

SEQ ID NO: 5858 - RNA, 27 nt, Artificial Sequence
  Synthetic Oligonucleotide
auucaagccauguuuaacagccucccu

SEQ ID NO: 5859 - RNA, 27 nt, Artificial Sequence
  Synthetic Oligonucleotide
agcuucuuggugacuucucgguccuug

SEQ ID NO: 5860 - RNA, 27 nt, Artificial Sequence
  Synthetic Oligonucleotide
uucucagccauuugauaucuucccagc

SEQ ID NO: 5861 - RNA, 27 nt, Artificial Sequence
  Synthetic Oligonucleotide
agccauuugauaucuucccagcugaua

SEQ ID NO: 5862 - RNA, 27 nt, Artificial Sequence
  Synthetic Oligonucleotide
caagaucccauucaagccauguuuaac

SEQ ID NO: 5863 - RNA, 27 nt, Artificial Sequence
  Synthetic Oligonucleotide
guccacugucgucuccaaaauuuuccu

SEQ ID NO: 5864 - RNA, 27 nt, Artificial Sequence
  Synthetic Oligonucleotide
gaggacaucuugaacaccuuucucccc

SEQ ID NO: 5865 - RNA, 27 nt, Artificial Sequence
  Synthetic Oligonucleotide
aucaccucucaaaaugcccuuugcaac

SEQ ID NO: 5866 - RNA, 27 nt, Artificial Sequence
  Synthetic Oligonucleotide
ccucucaaaaugcccuuugcaacaauu

SEQ ID NO: 5867 - RNA, 27 nt, Artificial Sequence
  Synthetic Oligonucleotide
aaagggauugcuauuuuguuggaaaag

SEQ ID NO: 5868 - RNA, 27 nt, Artificial Sequence
  Synthetic Oligonucleotide
acacccuuuguauugaaguggggaauu

SEQ ID NO: 5869 - RNA, 27 nt, Artificial Sequence
  Synthetic Oligonucleotide
ucauuugccccagaccuguaauaguca

SEQ ID NO: 5870 - RNA, 27 nt, Artificial Sequence
  Synthetic Oligonucleotide
uucccuuccacagccuccacaauuucu

SEQ ID NO: 5871 - RNA, 27 nt, Artificial Sequence
  Synthetic Oligonucleotide
uuacagacuguggucacccucugcaca

SEQ ID NO: 5872 - RNA, 27 nt, Artificial Sequence
  Synthetic Oligonucleotide
augcccuuugcaacaauuggcaaugau

SEQ ID NO: 5873 - RNA, 27 nt, Artificial Sequence
  Synthetic Oligonucleotide
gcaacauuccggagcauccuuggauac

SEQ ID NO: 5874 - RNA, 27 nt, Artificial Sequence
  Synthetic Oligonucleotide
caaccggaauucuuccuuuaguaucuc

SEQ ID NO: 5875 - RNA, 27 nt, Artificial Sequence
  Synthetic Oligonucleotide
guggucacccucugcacagugucucuu

SEQ ID NO: 5876 - RNA, 27 nt, Artificial Sequence
  Synthetic Oligonucleotide
aaguccacugucgucuccaaaauuuuc

SEQ ID NO: 5877 - RNA, 27 nt, Artificial Sequence
  Synthetic Oligonucleotide
cuguccuaaaacagaagucgacagauc

SEQ ID NO: 5878 - RNA, 27 nt, Artificial Sequence
  Synthetic Oligonucleotide
aguggggaauuacagacuguggucacc

SEQ ID NO: 5879 - RNA, 27 nt, Artificial Sequence
  Synthetic Oligonucleotide
cagacuguggucacccucugcacagug

SEQ ID NO: 5880 - RNA, 27 nt, Artificial Sequence
  Synthetic Oligonucleotide
aaaagguuccuaggacacccauugaaa

SEQ ID NO: 5881 - RNA, 27 nt, Artificial Sequence
  Synthetic Oligonucleotide
aagguuccuaggacacccauugaaaag

SEQ ID NO: 5882 - RNA, 27 nt, Artificial Sequence
  Synthetic Oligonucleotide
agaacaucagugccuuuccgcacaccc

SEQ ID NO: 5883 - RNA, 27 nt, Artificial Sequence
  Synthetic Oligonucleotide
agaugggucuauugcuuuagccacaua

SEQ ID NO: 5884 - RNA, 27 nt, Artificial Sequence
  Synthetic Oligonucleotide
gacccucuguccuaaaacagaagucga

SEQ ID NO: 5885 - RNA, 27 nt, Artificial Sequence
  Synthetic Oligonucleotide
agacacuaaagaugugauuggaaaucu

SEQ ID NO: 5886 - RNA, 27 nt, Artificial Sequence
  Synthetic Oligonucleotide
uucuuccuuuaguaucucgaggacauc

SEQ ID NO: 5887 - RNA, 27 nt, Artificial Sequence
  Synthetic Oligonucleotide
caucaccucucaaaaugcccuuugcaa

SEQ ID NO: 5888 - RNA, 27 nt, Artificial Sequence
  Synthetic Oligonucleotide
ccaaccggaauucuuccuuuaguaucu

SEQ ID NO: 5889 - RNA, 27 nt, Artificial Sequence
  Synthetic Oligonucleotide
auucgacaccaagaucccauucaagcc

SEQ ID NO: 5890 - RNA, 27 nt, Artificial Sequence
  Synthetic Oligonucleotide
caugcugacccucuguccuaaaacaga

SEQ ID NO: 5891 - RNA, 27 nt, Artificial Sequence
  Synthetic Oligonucleotide
ggaacucaacaucaugcccguucccag

SEQ ID NO: 5892 - RNA, 27 nt, Artificial Sequence
  Synthetic Oligonucleotide
uuggugacuucucgguccuuguagaua

SEQ ID NO: 5893 - RNA, 27 nt, Artificial Sequence
  Synthetic Oligonucleotide
gucgucuccaaaauuuuccucaggaga

SEQ ID NO: 5894 - RNA, 27 nt, Artificial Sequence
  Synthetic Oligonucleotide
ucccauucaagccauguuuaacagccu

SEQ ID NO: 5895 - RNA, 27 nt, Artificial Sequence
  Synthetic Oligonucleotide
acaucaauaguggcuggcaccccaucg

SEQ ID NO: 5896 - RNA, 27 nt, Artificial Sequence
  Synthetic Oligonucleotide
ucacaaauauggccuuguagcccaucu

SEQ ID NO: 5897 - RNA, 27 nt, Artificial Sequence
  Synthetic Oligonucleotide
aucccauucaagccauguuuaacagcc

SEQ ID NO: 5898 - RNA, 27 nt, Artificial Sequence
  Synthetic Oligonucleotide
uggcaucaucaccucucaaaaugcccu

SEQ ID NO: 5899 - RNA, 27 nt, Artificial Sequence
  Synthetic Oligonucleotide
caaguccacugucgucuccaaaauuuu

SEQ ID NO: 5900 - RNA, 27 nt, Artificial Sequence
  Synthetic Oligonucleotide
gaugacuuucacauucuggcacccacu

SEQ ID NO: 5901 - RNA, 27 nt, Artificial Sequence
  Synthetic Oligonucleotide
uguuacgcacaucauccagacgguugc

SEQ ID NO: 5902 - RNA, 27 nt, Artificial Sequence
  Synthetic Oligonucleotide
cccagcugauagaugggucuauugcuu

SEQ ID NO: 5903 - RNA, 27 nt, Artificial Sequence
  Synthetic Oligonucleotide
uuuagccacauaugcagcaaguccacu

SEQ ID NO: 5904 - RNA, 27 nt, Artificial Sequence
  Synthetic Oligonucleotide
aaugcccuuugcaacaauuggcaauga

SEQ ID NO: 5905 - RNA, 27 nt, Artificial Sequence
  Synthetic Oligonucleotide
aucauuugccccagaccuguaauaguc

SEQ ID NO: 5906 - RNA, 27 nt, Artificial Sequence
  Synthetic Oligonucleotide
cagcaacauuccggagcauccuuggau

SEQ ID NO: 5907 - RNA, 27 nt, Artificial Sequence
  Synthetic Oligonucleotide
cuuccacagccuccacaauuucuggca

SEQ ID NO: 5908 - RNA, 27 nt, Artificial Sequence
  Synthetic Oligonucleotide
ccacugucacaaauauggccuuguagc

SEQ ID NO: 5909 - RNA, 27 nt, Artificial Sequence
  Synthetic Oligonucleotide
uaucaccaauuaccgccacccauucca

SEQ ID NO: 5910 - RNA, 27 nt, Artificial Sequence
  Synthetic Oligonucleotide
aucaauaguggcuggcaccccaucgag

SEQ ID NO: 5911 - RNA, 27 nt, Artificial Sequence
  Synthetic Oligonucleotide
ccaagaucccauucaagccauguuuaa

SEQ ID NO: 5912 - RNA, 27 nt, Artificial Sequence
  Synthetic Oligonucleotide
cgacacccuuuguauugaaguggggaa

SEQ ID NO: 5913 - RNA, 27 nt, Artificial Sequence
  Synthetic Oligonucleotide
ccacuguuuuaaagacauguaaacaga

SEQ ID NO: 5914 - RNA, 27 nt, Artificial Sequence
  Synthetic Oligonucleotide
agagccagagcuuucagaacaucagug

SEQ ID NO: 5915 - RNA, 27 nt, Artificial Sequence
  Synthetic Oligonucleotide
uuucacauucuggcacccacucagagc

SEQ ID NO: 5916 - RNA, 27 nt, Artificial Sequence
  Synthetic Oligonucleotide
ccucugcacagugucucuuugucaagu

SEQ ID NO: 5917 - RNA, 27 nt, Artificial Sequence
  Synthetic Oligonucleotide
cccucuguccuaaaacagaagucgaca

SEQ ID NO: 5918 - RNA, 27 nt, Artificial Sequence
  Synthetic Oligonucleotide
augcagcaaguccacugucgucuccaa

SEQ ID NO: 5919 - RNA, 27 nt, Artificial Sequence
  Synthetic Oligonucleotide
ggcaucaucaccucucaaaaugcccuu

SEQ ID NO: 5920 - RNA, 27 nt, Artificial Sequence
  Synthetic Oligonucleotide
cuccagugcuaccuucucaaaguugug

SEQ ID NO: 5921 - RNA, 27 nt, Artificial Sequence
  Synthetic Oligonucleotide
ugucacaaauauggccuuguagcccau

SEQ ID NO: 5922 - RNA, 27 nt, Artificial Sequence
  Synthetic Oligonucleotide
cacuucuucaauugaggagguggccca

SEQ ID NO: 5923 - RNA, 27 nt, Artificial Sequence
  Synthetic Oligonucleotide
uugugcacugucagaucuuggaaacgg

SEQ ID NO: 5924 - RNA, 27 nt, Artificial Sequence
  Synthetic Oligonucleotide
agccaaaguuucuucaucauuugcccc

SEQ ID NO: 5925 - RNA, 27 nt, Artificial Sequence
  Synthetic Oligonucleotide
ccaugauucgacaccaagaucccauuc

SEQ ID NO: 5926 - RNA, 27 nt, Artificial Sequence
  Synthetic Oligonucleotide
guggcggcaguuugaaucuguuacgca

SEQ ID NO: 5927 - RNA, 27 nt, Artificial Sequence
  Synthetic Oligonucleotide
gucacaaauauggccuuguagcccauc

SEQ ID NO: 5928 - RNA, 27 nt, Artificial Sequence
  Synthetic Oligonucleotide
aggaacucaacaucaugcccguuccca

SEQ ID NO: 5929 - RNA, 27 nt, Artificial Sequence
  Synthetic Oligonucleotide
augcugacccucuguccuaaaacagaa

SEQ ID NO: 5930 - RNA, 27 nt, Artificial Sequence
  Synthetic Oligonucleotide
uuucauccugaguuguggcggcaguuu

SEQ ID NO: 5931 - RNA, 27 nt, Artificial Sequence
  Synthetic Oligonucleotide
aaauauggccuuguagcccaucuucuc

SEQ ID NO: 5932 - RNA, 27 nt, Artificial Sequence
  Synthetic Oligonucleotide
aguuguggcggcaguuugaaucuguua

SEQ ID NO: 5933 - RNA, 27 nt, Artificial Sequence
  Synthetic Oligonucleotide
agcaacauuccggagcauccuuggaua

SEQ ID NO: 5934 - RNA, 27 nt, Artificial Sequence
  Synthetic Oligonucleotide
uccuuggauacagcuuccaucuggaaa

SEQ ID NO: 5935 - RNA, 27 nt, Artificial Sequence
  Synthetic Oligonucleotide
uuccggagcauccuuggauacagcuuc

SEQ ID NO: 5936 - RNA, 27 nt, Artificial Sequence
  Synthetic Oligonucleotide
caucaauaguggcuggcaccccaucga

SEQ ID NO: 5937 - RNA, 27 nt, Artificial Sequence
  Synthetic Oligonucleotide
gcagcaaguccacugucgucuccaaaa

SEQ ID NO: 5938 - RNA, 27 nt, Artificial Sequence
  Synthetic Oligonucleotide
aagaucccauucaagccauguuuaaca

SEQ ID NO: 5939 - RNA, 27 nt, Artificial Sequence
  Synthetic Oligonucleotide
uauacaguugcagccaacgaagugccu

SEQ ID NO: 5940 - RNA, 27 nt, Artificial Sequence
  Synthetic Oligonucleotide
ucgacaccaagaucccauucaagccau

SEQ ID NO: 5941 - RNA, 27 nt, Artificial Sequence
  Synthetic Oligonucleotide
ucagccauuugauaucuucccagcuga

SEQ ID NO: 5942 - RNA, 27 nt, Artificial Sequence
  Synthetic Oligonucleotide
ccuuggauacagcuuccaucuggaaaa

SEQ ID NO: 5943 - RNA, 27 nt, Artificial Sequence
  Synthetic Oligonucleotide
ucccagcugauagaugggucuauugcu

SEQ ID NO: 5944 - RNA, 27 nt, Artificial Sequence
  Synthetic Oligonucleotide
auugugcacugucagaucuuggaaacg

SEQ ID NO: 5945 - RNA, 27 nt, Artificial Sequence
  Synthetic Oligonucleotide
cucuccagugcuaccuucucaaaguug

SEQ ID NO: 5946 - RNA, 27 nt, Artificial Sequence
  Synthetic Oligonucleotide
gggacugacaggcucucacaguggcaa

SEQ ID NO: 5947 - RNA, 27 nt, Artificial Sequence
  Synthetic Oligonucleotide
acaccaagaucccauucaagccauguu

SEQ ID NO: 5948 - RNA, 27 nt, Artificial Sequence
  Synthetic Oligonucleotide
ucucagccauuugauaucuucccagcu

SEQ ID NO: 5949 - RNA, 27 nt, Artificial Sequence
  Synthetic Oligonucleotide
gauucgacaccaagaucccauucaagc

SEQ ID NO: 5950 - RNA, 27 nt, Artificial Sequence
  Synthetic Oligonucleotide
uucccagcugauagaugggucuauugc

SEQ ID NO: 5951 - RNA, 27 nt, Artificial Sequence
  Synthetic Oligonucleotide
ccuaggacacccauugaaaagucaaaa

SEQ ID NO: 5952 - RNA, 27 nt, Artificial Sequence
  Synthetic Oligonucleotide
uggccaaccggaauucuuccuuuagua

SEQ ID NO: 5953 - RNA, 27 nt, Artificial Sequence
  Synthetic Oligonucleotide
uuuuucauccugaguuguggcggcagu

SEQ ID NO: 5954 - RNA, 27 nt, Artificial Sequence
  Synthetic Oligonucleotide
cggcaguuugaaucuguuacgcacauc

SEQ ID NO: 5955 - RNA, 27 nt, Artificial Sequence
  Synthetic Oligonucleotide
cagccaaaguuucuucaucauuugccc

SEQ ID NO: 5956 - RNA, 27 nt, Artificial Sequence
  Synthetic Oligonucleotide
ccaggaacucaacaucaugcccguucc

SEQ ID NO: 5957 - RNA, 27 nt, Artificial Sequence
  Synthetic Oligonucleotide
uucgacaccaagaucccauucaagcca

SEQ ID NO: 5958 - RNA, 27 nt, Artificial Sequence
  Synthetic Oligonucleotide
ggccaaaggauuuuuccucaccaaugu

SEQ ID NO: 5959 - RNA, 27 nt, Artificial Sequence
  Synthetic Oligonucleotide
ucgaguugucgagccccaugauucgac

SEQ ID NO: 5960 - RNA, 27 nt, Artificial Sequence
  Synthetic Oligonucleotide
acaaauauggccuuguagcccaucuuc

SEQ ID NO: 5961 - RNA, 27 nt, Artificial Sequence
  Synthetic Oligonucleotide
gcggcaguuugaaucuguuacgcacau

SEQ ID NO: 5962 - RNA, 27 nt, Artificial Sequence
  Synthetic Oligonucleotide
ucucuccagugcuaccuucucaaaguu

SEQ ID NO: 5963 - RNA, 27 nt, Artificial Sequence
  Synthetic Oligonucleotide
ucaucauuugccccagaccuguaauag

SEQ ID NO: 5964 - RNA, 27 nt, Artificial Sequence
  Synthetic Oligonucleotide
uccuaggacacccauugaaaagucaaa

SEQ ID NO: 5965 - RNA, 27 nt, Artificial Sequence
  Synthetic Oligonucleotide
gacuguggucacccucugcacaguguc

SEQ ID NO: 5966 - RNA, 27 nt, Artificial Sequence
  Synthetic Oligonucleotide
ucccuuccacagccuccacaauuucug

SEQ ID NO: 5967 - RNA, 27 nt, Artificial Sequence
  Synthetic Oligonucleotide
aaaugcccuuugcaacaauuggcaaug

SEQ ID NO: 5968 - RNA, 27 nt, Artificial Sequence
  Synthetic Oligonucleotide
aagacuuccaccuucccuuccacagcc

SEQ ID NO: 5969 - RNA, 27 nt, Artificial Sequence
  Synthetic Oligonucleotide
cugacaggcucucacaguggcaagcuc

SEQ ID NO: 5970 - RNA, 27 nt, Artificial Sequence
  Synthetic Oligonucleotide
gcaugcugacccucuguccuaaaacag

SEQ ID NO: 5971 - RNA, 27 nt, Artificial Sequence
  Synthetic Oligonucleotide
ccaggaagacuuccaccuucccuucca

SEQ ID NO: 5972 - RNA, 27 nt, Artificial Sequence
  Synthetic Oligonucleotide
gccaaaguuucuucaucauuugcccca

SEQ ID NO: 5973 - RNA, 27 nt, Artificial Sequence
  Synthetic Oligonucleotide
uucauccugaguuguggcggcaguuug

SEQ ID NO: 5974 - RNA, 27 nt, Artificial Sequence
  Synthetic Oligonucleotide
uccggagcauccuuggauacagcuucc

SEQ ID NO: 5975 - RNA, 27 nt, Artificial Sequence
  Synthetic Oligonucleotide
uuggcaugcugacccucuguccuaaaa

SEQ ID NO: 5976 - RNA, 27 nt, Artificial Sequence
  Synthetic Oligonucleotide
cuuuagccacauaugcagcaaguccac

SEQ ID NO: 5977 - RNA, 27 nt, Artificial Sequence
  Synthetic Oligonucleotide
uucacauucuggcacccacucagagcc

SEQ ID NO: 5978 - RNA, 27 nt, Artificial Sequence
  Synthetic Oligonucleotide
ccccagaccuguaauagucauauauag

SEQ ID NO: 5979 - RNA, 27 nt, Artificial Sequence
  Synthetic Oligonucleotide
uuguggcggcaguuugaaucuguuacg

SEQ ID NO: 5980 - RNA, 27 nt, Artificial Sequence
  Synthetic Oligonucleotide
cagacacuaaagaugugauuggaaauc

SEQ ID NO: 5981 - RNA, 27 nt, Artificial Sequence
  Synthetic Oligonucleotide
ggucacccucugcacagugucucuuug

SEQ ID NO: 5982 - RNA, 27 nt, Artificial Sequence
  Synthetic Oligonucleotide
ggaagacuuccaccuucccuuccacag

SEQ ID NO: 5983 - RNA, 27 nt, Artificial Sequence
  Synthetic Oligonucleotide
cacuagcuucuuggugacuucucgguc

SEQ ID NO: 5984 - RNA, 27 nt, Artificial Sequence
  Synthetic Oligonucleotide
uacgcacaucauccagacgguugccca

SEQ ID NO: 5985 - RNA, 27 nt, Artificial Sequence
  Synthetic Oligonucleotide
uaaaggauacagcacuuuagccugcca

SEQ ID NO: 5986 - RNA, 27 nt, Artificial Sequence
  Synthetic Oligonucleotide
cauucaagccauguuuaacagccuccc

SEQ ID NO: 5987 - RNA, 27 nt, Artificial Sequence
  Synthetic Oligonucleotide
aauuaccgccacccauuccaauucucu

SEQ ID NO: 5988 - RNA, 27 nt, Artificial Sequence
  Synthetic Oligonucleotide
gguuccuaggacacccauugaaaaguc

SEQ ID NO: 5989 - RNA, 27 nt, Artificial Sequence
  Synthetic Oligonucleotide
cauguuuaacagccucccuggcaucau

SEQ ID NO: 5990 - RNA, 27 nt, Artificial Sequence
  Synthetic Oligonucleotide
cugaguuguggcggcaguuugaaucug

SEQ ID NO: 5991 - RNA, 27 nt, Artificial Sequence
  Synthetic Oligonucleotide
uauuggcaugcugacccucuguccuaa

SEQ ID NO: 5992 - RNA, 27 nt, Artificial Sequence
  Synthetic Oligonucleotide
cuguggucacccucugcacagugucuc

SEQ ID NO: 5993 - RNA, 27 nt, Artificial Sequence
  Synthetic Oligonucleotide
uugucgagccccaugauucgacaccaa

SEQ ID NO: 5994 - RNA, 27 nt, Artificial Sequence
  Synthetic Oligonucleotide
ucuucccagcugauagaugggucuauu

SEQ ID NO: 5995 - RNA, 27 nt, Artificial Sequence
  Synthetic Oligonucleotide
gacaccaagaucccauucaagccaugu

SEQ ID NO: 5996 - RNA, 27 nt, Artificial Sequence
  Synthetic Oligonucleotide
cauccugaguuguggcggcaguuugaa

SEQ ID NO: 5997 - RNA, 27 nt, Artificial Sequence
  Synthetic Oligonucleotide
uguuuaacagccucccuggcaucauca

SEQ ID NO: 5998 - RNA, 27 nt, Artificial Sequence
  Synthetic Oligonucleotide
uucuucaauugaggagguggcccagga

SEQ ID NO: 5999 - RNA, 27 nt, Artificial Sequence
  Synthetic Oligonucleotide
ccaagagccagagcuuucagaacauca

SEQ ID NO: 6000 - RNA, 27 nt, Artificial Sequence
  Synthetic Oligonucleotide
caucauuugccccagaccuguaauagu

SEQ ID NO: 6001 - RNA, 27 nt, Artificial Sequence
  Synthetic Oligonucleotide
aacaucaauaguggcuggcaccccauc

SEQ ID NO: 6002 - RNA, 27 nt, Artificial Sequence
  Synthetic Oligonucleotide
acccucuguccuaaaacagaagucgac

SEQ ID NO: 6003 - RNA, 27 nt, Artificial Sequence
  Synthetic Oligonucleotide
acuguggucacccucugcacagugucu

SEQ ID NO: 6004 - RNA, 27 nt, Artificial Sequence
  Synthetic Oligonucleotide
auuggcaugcugacccucuguccuaaa

SEQ ID NO: 6005 - RNA, 27 nt, Artificial Sequence
  Synthetic Oligonucleotide
caggaagacuuccaccuucccuuccac

SEQ ID NO: 6006 - RNA, 27 nt, Artificial Sequence
  Synthetic Oligonucleotide
ccagagcuuucagaacaucagugccuu

SEQ ID NO: 6007 - RNA, 27 nt, Artificial Sequence
  Synthetic Oligonucleotide
cuucaucauuugccccagaccuguaau

SEQ ID NO: 6008 - RNA, 27 nt, Artificial Sequence
  Synthetic Oligonucleotide
caauuaccgccacccauuccaauucuc

SEQ ID NO: 6009 - RNA, 27 nt, Artificial Sequence
  Synthetic Oligonucleotide
ggugacuucucgguccuuguagauaua

SEQ ID NO: 6010 - RNA, 27 nt, Artificial Sequence
  Synthetic Oligonucleotide
gaguuguggcggcaguuugaaucuguu

SEQ ID NO: 6011 - RNA, 27 nt, Artificial Sequence
  Synthetic Oligonucleotide
aguuucuucaucauuugccccagaccu

SEQ ID NO: 6012 - RNA, 27 nt, Artificial Sequence
  Synthetic Oligonucleotide
uuacgcacaucauccagacgguugccc

SEQ ID NO: 6013 - RNA, 27 nt, Artificial Sequence
  Synthetic Oligonucleotide
uucaucauuugccccagaccuguaaua

SEQ ID NO: 6014 - RNA, 27 nt, Artificial Sequence
  Synthetic Oligonucleotide
ccaaaguuucuucaucauuugccccag

SEQ ID NO: 6015 - RNA, 27 nt, Artificial Sequence
  Synthetic Oligonucleotide
caaauauggccuuguagcccaucuucu

SEQ ID NO: 6016 - RNA, 27 nt, Artificial Sequence
  Synthetic Oligonucleotide
ugcagcaaguccacugucgucuccaaa

SEQ ID NO: 6017 - RNA, 27 nt, Artificial Sequence
  Synthetic Oligonucleotide
ucccuggcaucaucaccucucaaaaug

SEQ ID NO: 6018 - RNA, 27 nt, Artificial Sequence
  Synthetic Oligonucleotide
ccgcacuagcuucuuggugacuucucg

SEQ ID NO: 6019 - RNA, 27 nt, Artificial Sequence
  Synthetic Oligonucleotide
caggaacucaacaucaugcccguuccc

SEQ ID NO: 6020 - RNA, 27 nt, Artificial Sequence
  Synthetic Oligonucleotide
accaauuaccgccacccauuccaauuc

SEQ ID NO: 6021 - RNA, 27 nt, Artificial Sequence
  Synthetic Oligonucleotide
cagccuccacaauuucuggcagaacau

SEQ ID NO: 6022 - RNA, 27 nt, Artificial Sequence
  Synthetic Oligonucleotide
agacuuccaccuucccuuccacagccu

SEQ ID NO: 6023 - RNA, 27 nt, Artificial Sequence
  Synthetic Oligonucleotide
aaagcuaagccccaaacgauuggucuc

SEQ ID NO: 6024 - RNA, 27 nt, Artificial Sequence
  Synthetic Oligonucleotide
ucauccugaguuguggcggcaguuuga

SEQ ID NO: 6025 - RNA, 27 nt, Artificial Sequence
  Synthetic Oligonucleotide
aaguuucuucaucauuugccccagacc

SEQ ID NO: 6026 - RNA, 27 nt, Artificial Sequence
  Synthetic Oligonucleotide
ccagcuuccgccacuucuucaauugag

SEQ ID NO: 6027 - RNA, 27 nt, Artificial Sequence
  Synthetic Oligonucleotide
acuaaaggauacagcacuuuagccugc

SEQ ID NO: 6028 - RNA, 27 nt, Artificial Sequence
  Synthetic Oligonucleotide
cucagccauuugauaucuucccagcug

SEQ ID NO: 6029 - RNA, 27 nt, Artificial Sequence
  Synthetic Oligonucleotide
auuccggagcauccuuggauacagcuu

SEQ ID NO: 6030 - RNA, 27 nt, Artificial Sequence
  Synthetic Oligonucleotide
ugacaggcucucacaguggcaagcucg

SEQ ID NO: 6031 - RNA, 27 nt, Artificial Sequence
  Synthetic Oligonucleotide
aacucaacaucaugcccguucccaggg

SEQ ID NO: 6032 - RNA, 27 nt, Artificial Sequence
  Synthetic Oligonucleotide
aucaccaauuaccgccacccauuccaa

SEQ ID NO: 6033 - RNA, 27 nt, Artificial Sequence
  Synthetic Oligonucleotide
uuaacagccucccuggcaucaucaccu

SEQ ID NO: 6034 - RNA, 27 nt, Artificial Sequence
  Synthetic Oligonucleotide
ugccaggggaugacguugucuaaacac

SEQ ID NO: 6035 - RNA, 27 nt, Artificial Sequence
  Synthetic Oligonucleotide
cagcaaguccacugucgucuccaaaau

SEQ ID NO: 6036 - RNA, 27 nt, Artificial Sequence
  Synthetic Oligonucleotide
ccuggcaucaucaccucucaaaaugcc

SEQ ID NO: 6037 - RNA, 27 nt, Artificial Sequence
  Synthetic Oligonucleotide
cacaaauauggccuuguagcccaucuu

SEQ ID NO: 6038 - RNA, 27 nt, Artificial Sequence
  Synthetic Oligonucleotide
gccaaccggaauucuuccuuuaguauc

SEQ ID NO: 6039 - RNA, 27 nt, Artificial Sequence
  Synthetic Oligonucleotide
cucccuggcaucaucaccucucaaaau

SEQ ID NO: 6040 - RNA, 27 nt, Artificial Sequence
  Synthetic Oligonucleotide
gccagagcuuucagaacaucagugccu

SEQ ID NO: 6041 - RNA, 27 nt, Artificial Sequence
  Synthetic Oligonucleotide
uucaagccauguuuaacagccucccug

SEQ ID NO: 6042 - RNA, 27 nt, Artificial Sequence
  Synthetic Oligonucleotide
ugcugacccucuguccuaaaacagaag

SEQ ID NO: 6043 - RNA, 27 nt, Artificial Sequence
  Synthetic Oligonucleotide
guuguggcggcaguuugaaucuguuac

SEQ ID NO: 6044 - RNA, 27 nt, Artificial Sequence
  Synthetic Oligonucleotide
uuccacagccuccacaauuucuggcag

SEQ ID NO: 6045 - RNA, 27 nt, Artificial Sequence
  Synthetic Oligonucleotide
guuacgcacaucauccagacgguugcc

SEQ ID NO: 6046 - RNA, 27 nt, Artificial Sequence
  Synthetic Oligonucleotide
aauauggccuuguagcccaucuucucu

SEQ ID NO: 6047 - RNA, 27 nt, Artificial Sequence
  Synthetic Oligonucleotide
aucuucccagcugauagaugggucuau

SEQ ID NO: 6048 - RNA, 27 nt, Artificial Sequence
  Synthetic Oligonucleotide
ucacauucuggcacccacucagagcca

SEQ ID NO: 6049 - RNA, 27 nt, Artificial Sequence
  Synthetic Oligonucleotide
ugugcacugucagaucuuggaaacggc

SEQ ID NO: 6050 - RNA, 27 nt, Artificial Sequence
  Synthetic Oligonucleotide
gaacaucagugccuuuccgcacacccc

SEQ ID NO: 6051 - RNA, 27 nt, Artificial Sequence
  Synthetic Oligonucleotide
accagcuuccgccacuucuucaauuga

SEQ ID NO: 6052 - RNA, 27 nt, Artificial Sequence
  Synthetic Oligonucleotide
cuucuucaauugaggagguggcccagg

SEQ ID NO: 6053 - RNA, 27 nt, Artificial Sequence
  Synthetic Oligonucleotide
uuccgccacuucuucaauugaggaggu

SEQ ID NO: 6054 - RNA, 27 nt, Artificial Sequence
  Synthetic Oligonucleotide
agaucccauucaagccauguuuaacag

SEQ ID NO: 6055 - RNA, 27 nt, Artificial Sequence
  Synthetic Oligonucleotide
ugcacugucagaucuuggaaacggcca

SEQ ID NO: 6056 - RNA, 27 nt, Artificial Sequence
  Synthetic Oligonucleotide
agcuuccgccacuucuucaauugagga

SEQ ID NO: 6057 - RNA, 27 nt, Artificial Sequence
  Synthetic Oligonucleotide
gccccagaccuguaauagucauauaua

SEQ ID NO: 6058 - RNA, 27 nt, Artificial Sequence
  Synthetic Oligonucleotide
auauacaguugcagccaacgaagugcc

SEQ ID NO: 6059 - RNA, 27 nt, Artificial Sequence
  Synthetic Oligonucleotide
ucuucaauugaggagguggcccaggaa

SEQ ID NO: 6060 - RNA, 27 nt, Artificial Sequence
  Synthetic Oligonucleotide
cauuccggagcauccuuggauacagcu

SEQ ID NO: 6061 - RNA, 27 nt, Artificial Sequence
  Synthetic Oligonucleotide
accaagaucccauucaagccauguuua

SEQ ID NO: 6062 - RNA, 27 nt, Artificial Sequence
  Synthetic Oligonucleotide
agacuguggucacccucugcacagugu

SEQ ID NO: 6063 - RNA, 27 nt, Artificial Sequence
  Synthetic Oligonucleotide
uuggaaacggccaaaggauuuuuccuc

SEQ ID NO: 6064 - RNA, 27 nt, Artificial Sequence
  Synthetic Oligonucleotide
auuaccgccacccauuccaauucucuc

SEQ ID NO: 6065 - RNA, 27 nt, Artificial Sequence
  Synthetic Oligonucleotide
ucaggaccagcuuccgccacuucuuca

SEQ ID NO: 6066 - RNA, 27 nt, Artificial Sequence
  Synthetic Oligonucleotide
gacacccuuuguauugaaguggggaau

SEQ ID NO: 6067 - RNA, 27 nt, Artificial Sequence
  Synthetic Oligonucleotide
ggccaaccggaauucuuccuuuaguau

SEQ ID NO: 6068 - RNA, 27 nt, Artificial Sequence
  Synthetic Oligonucleotide
aggaagacuuccaccuucccuuccaca

SEQ ID NO: 6069 - RNA, 27 nt, Artificial Sequence
  Synthetic Oligonucleotide
auuugccccagaccuguaauagucaua

SEQ ID NO: 6070 - RNA, 27 nt, Artificial Sequence
  Synthetic Oligonucleotide
agggacugacaggcucucacaguggca

SEQ ID NO: 6071 - RNA, 27 nt, Artificial Sequence
  Synthetic Oligonucleotide
ucaccaauuaccgccacccauuccaau

SEQ ID NO: 6072 - RNA, 27 nt, Artificial Sequence
  Synthetic Oligonucleotide
cagcuuccgccacuucuucaauugagg

SEQ ID NO: 6073 - RNA, 27 nt, Artificial Sequence
  Synthetic Oligonucleotide
aauaguggcuggcaccccaucgaguug

SEQ ID NO: 6074 - RNA, 27 nt, Artificial Sequence
  Synthetic Oligonucleotide
uccgccacuucuucaauugaggaggug

SEQ ID NO: 6075 - RNA, 27 nt, Artificial Sequence
  Synthetic Oligonucleotide
ccaauuaccgccacccauuccaauucu

SEQ ID NO: 6076 - RNA, 27 nt, Artificial Sequence
  Synthetic Oligonucleotide
cuuggaaacggccaaaggauuuuuccu

SEQ ID NO: 6077 - RNA, 27 nt, Artificial Sequence
  Synthetic Oligonucleotide
uccaggaagacuuccaccuucccuucc

SEQ ID NO: 6078 - RNA, 27 nt, Artificial Sequence
  Synthetic Oligonucleotide
cagccauuugauaucuucccagcugau

SEQ ID NO: 6079 - RNA, 27 nt, Artificial Sequence
  Synthetic Oligonucleotide
gcuuccgccacuucuucaauugaggag

SEQ ID NO: 6080 - RNA, 27 nt, Artificial Sequence
  Synthetic Oligonucleotide
ugacccucuguccuaaaacagaagucg

SEQ ID NO: 6081 - RNA, 27 nt, Artificial Sequence
  Synthetic Oligonucleotide
ccacccauuccaauucucuccagugcu

SEQ ID NO: 6082 - RNA, 27 nt, Artificial Sequence
  Synthetic Oligonucleotide
uggaaagcuaagccccaaacgauuggu

SEQ ID NO: 6083 - RNA, 27 nt, Artificial Sequence
  Synthetic Oligonucleotide
ccacuucuucaauugaggagguggccc

SEQ ID NO: 6084 - RNA, 27 nt, Artificial Sequence
  Synthetic Oligonucleotide
gaucccauucaagccauguuuaacagc

SEQ ID NO: 6085 - RNA, 27 nt, Artificial Sequence
  Synthetic Oligonucleotide
aagagccagagcuuucagaacaucagu

SEQ ID NO: 6086 - RNA, 27 nt, Artificial Sequence
  Synthetic Oligonucleotide
uggcggcaguuugaaucuguuacgcac

SEQ ID NO: 6087 - RNA, 27 nt, Artificial Sequence
  Synthetic Oligonucleotide
uccugaguuguggcggcaguuugaauc

SEQ ID NO: 6088 - RNA, 27 nt, Artificial Sequence
  Synthetic Oligonucleotide
caccaauuaccgccacccauuccaauu

SEQ ID NO: 6089 - RNA, 27 nt, Artificial Sequence
  Synthetic Oligonucleotide
uggaaacggccaaaggauuuuuccuca

SEQ ID NO: 6090 - RNA, 27 nt, Artificial Sequence
  Synthetic Oligonucleotide
aaaggauacagcacuuuagccugccag

SEQ ID NO: 6091 - RNA, 27 nt, Artificial Sequence
  Synthetic Oligonucleotide
auguuuaacagccucccuggcaucauc

SEQ ID NO: 6092 - RNA, 27 nt, Artificial Sequence
  Synthetic Oligonucleotide
ggacugacaggcucucacaguggcaag

SEQ ID NO: 6093 - RNA, 27 nt, Artificial Sequence
  Synthetic Oligonucleotide
cccuggcaucaucaccucucaaaaugc

SEQ ID NO: 6094 - RNA, 27 nt, Artificial Sequence
  Synthetic Oligonucleotide
uucaauugaggagguggcccaggaacu

SEQ ID NO: 6095 - RNA, 27 nt, Artificial Sequence
  Synthetic Oligonucleotide
ugccccagaccuguaauagucauauau

SEQ ID NO: 6096 - RNA, 27 nt, Artificial Sequence
  Synthetic Oligonucleotide
agccacauaugcagcaaguccacuguc

SEQ ID NO: 6097 - RNA, 27 nt, Artificial Sequence
  Synthetic Oligonucleotide
cugccaggggaugacguugucuaaaca

SEQ ID NO: 6098 - RNA, 27 nt, Artificial Sequence
  Synthetic Oligonucleotide
acagccuccacaauuucuggcagaaca

SEQ ID NO: 6099 - RNA, 27 nt, Artificial Sequence
  Synthetic Oligonucleotide
caauaguggcuggcaccccaucgaguu

SEQ ID NO: 6100 - RNA, 27 nt, Artificial Sequence
  Synthetic Oligonucleotide
gccgcacuagcuucuuggugacuucuc

SEQ ID NO: 6101 - RNA, 27 nt, Artificial Sequence
  Synthetic Oligonucleotide
cagaacaucagugccuuuccgcacacc

SEQ ID NO: 6102 - RNA, 27 nt, Artificial Sequence
  Synthetic Oligonucleotide
ccauucaagccauguuuaacagccucc

SEQ ID NO: 6103 - RNA, 27 nt, Artificial Sequence
  Synthetic Oligonucleotide
ccaccuucccuuccacagccuccacaa

SEQ ID NO: 6104 - RNA, 27 nt, Artificial Sequence
  Synthetic Oligonucleotide
ugucgagccccaugauucgacaccaag

SEQ ID NO: 6105 - RNA, 27 nt, Artificial Sequence
  Synthetic Oligonucleotide
auccugaguuguggcggcaguuugaau

SEQ ID NO: 6106 - RNA, 27 nt, Artificial Sequence
  Synthetic Oligonucleotide
guuuaacagccucccuggcaucaucac

SEQ ID NO: 6107 - RNA, 27 nt, Artificial Sequence
  Synthetic Oligonucleotide
uuugccccagaccuguaauagucauau

SEQ ID NO: 6108 - RNA, 27 nt, Artificial Sequence
  Synthetic Oligonucleotide
guggcuggcaccccaucgaguugucga

SEQ ID NO: 6109 - RNA, 27 nt, Artificial Sequence
  Synthetic Oligonucleotide
aacggccaaaggauuuuuccucaccaa

SEQ ID NO: 6110 - RNA, 27 nt, Artificial Sequence
  Synthetic Oligonucleotide
cauggccaaccggaauucuuccuuuag

SEQ ID NO: 6111 - RNA, 27 nt, Artificial Sequence
  Synthetic Oligonucleotide
uguggcggcaguuugaaucuguuacgc

SEQ ID NO: 6112 - RNA, 27 nt, Artificial Sequence
  Synthetic Oligonucleotide
gacugacaggcucucacaguggcaagc

SEQ ID NO: 6113 - RNA, 27 nt, Artificial Sequence
  Synthetic Oligonucleotide
gaacucaacaucaugcccguucccagg

SEQ ID NO: 6114 - RNA, 27 nt, Artificial Sequence
  Synthetic Oligonucleotide
uccacagccuccacaauuucuggcaga

SEQ ID NO: 6115 - RNA, 27 nt, Artificial Sequence
  Synthetic Oligonucleotide
uugccccagaccuguaauagucauaua

SEQ ID NO: 6116 - RNA, 27 nt, Artificial Sequence
  Synthetic Oligonucleotide
cccaggaacucaacaucaugcccguuc

SEQ ID NO: 6117 - RNA, 27 nt, Artificial Sequence
  Synthetic Oligonucleotide
cccauucaagccauguuuaacagccuc

SEQ ID NO: 6118 - RNA, 27 nt, Artificial Sequence
  Synthetic Oligonucleotide
agccagagcuuucagaacaucagugcc

SEQ ID NO: 6119 - RNA, 27 nt, Artificial Sequence
  Synthetic Oligonucleotide
ccccaugauucgacaccaagaucccau

SEQ ID NO: 6120 - RNA, 27 nt, Artificial Sequence
  Synthetic Oligonucleotide
gaaagcuaagccccaaacgauuggucu

SEQ ID NO: 6121 - RNA, 27 nt, Artificial Sequence
  Synthetic Oligonucleotide
uagccugccaggggaugacguugucua

SEQ ID NO: 6122 - RNA, 27 nt, Artificial Sequence
  Synthetic Oligonucleotide
acagacuguggucacccucugcacagu

SEQ ID NO: 6123 - RNA, 27 nt, Artificial Sequence
  Synthetic Oligonucleotide
ucaauaguggcuggcaccccaucgagu

SEQ ID NO: 6124 - RNA, 27 nt, Artificial Sequence
  Synthetic Oligonucleotide
acaucauccagacgguugcccagguaa

SEQ ID NO: 6125 - RNA, 27 nt, Artificial Sequence
  Synthetic Oligonucleotide
ccggagcauccuuggauacagcuucca

SEQ ID NO: 6126 - RNA, 27 nt, Artificial Sequence
  Synthetic Oligonucleotide
guugucgagccccaugauucgacacca

SEQ ID NO: 6127 - RNA, 27 nt, Artificial Sequence
  Synthetic Oligonucleotide
cauuugccccagaccuguaauagucau

SEQ ID NO: 6128 - RNA, 27 nt, Artificial Sequence
  Synthetic Oligonucleotide
cacaucauccagacgguugcccaggua

SEQ ID NO: 6129 - RNA, 27 nt, Artificial Sequence
  Synthetic Oligonucleotide
gaguugucgagccccaugauucgacac

SEQ ID NO: 6130 - RNA, 27 nt, Artificial Sequence
  Synthetic Oligonucleotide
gccacuucuucaauugaggagguggcc

SEQ ID NO: 6131 - RNA, 27 nt, Artificial Sequence
  Synthetic Oligonucleotide
gacuuccaccuucccuuccacagccuc

SEQ ID NO: 6132 - RNA, 27 nt, Artificial Sequence
  Synthetic Oligonucleotide
uggcaugcugacccucuguccuaaaac

SEQ ID NO: 6133 - RNA, 27 nt, Artificial Sequence
  Synthetic Oligonucleotide
ucuuggaaacggccaaaggauuuuucc

SEQ ID NO: 6134 - RNA, 27 nt, Artificial Sequence
  Synthetic Oligonucleotide
caagagccagagcuuucagaacaucag

SEQ ID NO: 6135 - RNA, 27 nt, Artificial Sequence
  Synthetic Oligonucleotide
cugacccucuguccuaaaacagaaguc

SEQ ID NO: 6136 - RNA, 27 nt, Artificial Sequence
  Synthetic Oligonucleotide
cguccaggaagacuuccaccuucccuu

SEQ ID NO: 6137 - RNA, 27 nt, Artificial Sequence
  Synthetic Oligonucleotide
cgucuccaaaauuuuccucaggagaaa

SEQ ID NO: 6138 - RNA, 27 nt, Artificial Sequence
  Synthetic Oligonucleotide
uucucugccugccgcacuagcuucuug

SEQ ID NO: 6139 - RNA, 27 nt, Artificial Sequence
  Synthetic Oligonucleotide
gaagacuuccaccuucccuuccacagc

SEQ ID NO: 6140 - RNA, 27 nt, Artificial Sequence
  Synthetic Oligonucleotide
acaguugcagccaacgaagugccucag

SEQ ID NO: 6141 - RNA, 27 nt, Artificial Sequence
  Synthetic Oligonucleotide
ggcggcaguuugaaucuguuacgcaca

SEQ ID NO: 6142 - RNA, 27 nt, Artificial Sequence
  Synthetic Oligonucleotide
ugucagaucuuggaaacggccaaagga

SEQ ID NO: 6143 - RNA, 27 nt, Artificial Sequence
  Synthetic Oligonucleotide
cgaguugucgagccccaugauucgaca

SEQ ID NO: 6144 - RNA, 27 nt, Artificial Sequence
  Synthetic Oligonucleotide
cacugucagaucuuggaaacggccaaa

SEQ ID NO: 6145 - RNA, 27 nt, Artificial Sequence
  Synthetic Oligonucleotide
cacuuuagccugccaggggaugacguu

SEQ ID NO: 6146 - RNA, 27 nt, Artificial Sequence
  Synthetic Oligonucleotide
aaacggccaaaggauuuuuccucacca

SEQ ID NO: 6147 - RNA, 27 nt, Artificial Sequence
  Synthetic Oligonucleotide
uuuaacagccucccuggcaucaucacc

SEQ ID NO: 6148 - RNA, 27 nt, Artificial Sequence
  Synthetic Oligonucleotide
auggccaaccggaauucuuccuuuagu

SEQ ID NO: 6149 - RNA, 27 nt, Artificial Sequence
  Synthetic Oligonucleotide
gcugacccucuguccuaaaacagaagu

SEQ ID NO: 6150 - RNA, 27 nt, Artificial Sequence
  Synthetic Oligonucleotide
cugucagaucuuggaaacggccaaagg

SEQ ID NO: 6151 - RNA, 27 nt, Artificial Sequence
  Synthetic Oligonucleotide
ccgccacuucuucaauugaggaggugg

SEQ ID NO: 6152 - RNA, 27 nt, Artificial Sequence
  Synthetic Oligonucleotide
gucagaucuuggaaacggccaaaggau

SEQ ID NO: 6153 - RNA, 27 nt, Artificial Sequence
  Synthetic Oligonucleotide
aguugucgagccccaugauucgacacc

SEQ ID NO: 6154 - RNA, 27 nt, Artificial Sequence
  Synthetic Oligonucleotide
acuuccaccuucccuuccacagccucc

SEQ ID NO: 6155 - RNA, 27 nt, Artificial Sequence
  Synthetic Oligonucleotide
caccuucccuuccacagccuccacaau

SEQ ID NO: 6156 - RNA, 27 nt, Artificial Sequence
  Synthetic Oligonucleotide
cuggaaagcuaagccccaaacgauugg

SEQ ID NO: 6157 - RNA, 27 nt, Artificial Sequence
  Synthetic Oligonucleotide
ccuuccacagccuccacaauuucuggc

SEQ ID NO: 6158 - RNA, 27 nt, Artificial Sequence
  Synthetic Oligonucleotide
gcacaucauccagacgguugcccaggu

SEQ ID NO: 6159 - RNA, 27 nt, Artificial Sequence
  Synthetic Oligonucleotide
aacgaagugccucaggaccagcuuccg

SEQ ID NO: 6160 - RNA, 27 nt, Artificial Sequence
  Synthetic Oligonucleotide
caccaagaucccauucaagccauguuu

SEQ ID NO: 6161 - RNA, 27 nt, Artificial Sequence
  Synthetic Oligonucleotide
auacaguugcagccaacgaagugccuc

SEQ ID NO: 6162 - RNA, 27 nt, Artificial Sequence
  Synthetic Oligonucleotide
uucccagggacugacaggcucucacag

SEQ ID NO: 6163 - RNA, 27 nt, Artificial Sequence
  Synthetic Oligonucleotide
ccauguuuaacagccucccuggcauca

SEQ ID NO: 6164 - RNA, 27 nt, Artificial Sequence
  Synthetic Oligonucleotide
cggccaaaggauuuuuccucaccaaug

SEQ ID NO: 6165 - RNA, 27 nt, Artificial Sequence
  Synthetic Oligonucleotide
cagggacugacaggcucucacaguggc

SEQ ID NO: 6166 - RNA, 27 nt, Artificial Sequence
  Synthetic Oligonucleotide
cucucacaguggcaagcucgccgucca

SEQ ID NO: 6167 - RNA, 27 nt, Artificial Sequence
  Synthetic Oligonucleotide
caacgaagugccucaggaccagcuucc

SEQ ID NO: 6168 - RNA, 27 nt, Artificial Sequence
  Synthetic Oligonucleotide
acucaacaucaugcccguucccaggga

SEQ ID NO: 6169 - RNA, 27 nt, Artificial Sequence
  Synthetic Oligonucleotide
cccaugauucgacaccaagaucccauu

SEQ ID NO: 6170 - RNA, 27 nt, Artificial Sequence
  Synthetic Oligonucleotide
ucaauugaggagguggcccaggaacuc

SEQ ID NO: 6171 - RNA, 27 nt, Artificial Sequence
  Synthetic Oligonucleotide
aucuuggaaacggccaaaggauuuuuc

SEQ ID NO: 6172 - RNA, 27 nt, Artificial Sequence
  Synthetic Oligonucleotide
guccaggaagacuuccaccuucccuuc

SEQ ID NO: 6173 - RNA, 27 nt, Artificial Sequence
  Synthetic Oligonucleotide
aauugaggagguggcccaggaacucaa

SEQ ID NO: 6174 - RNA, 27 nt, Artificial Sequence
  Synthetic Oligonucleotide
gaccagcuuccgccacuucuucaauug

SEQ ID NO: 6175 - RNA, 27 nt, Artificial Sequence
  Synthetic Oligonucleotide
ccuggaaagcuaagccccaaacgauug

SEQ ID NO: 6176 - RNA, 27 nt, Artificial Sequence
  Synthetic Oligonucleotide
acugucagaucuuggaaacggccaaag

SEQ ID NO: 6177 - RNA, 27 nt, Artificial Sequence
  Synthetic Oligonucleotide
agccauggccaaccggaauucuuccuu

SEQ ID NO: 6178 - RNA, 27 nt, Artificial Sequence
  Synthetic Oligonucleotide
ucaagccauguuuaacagccucccugg

SEQ ID NO: 6179 - RNA, 27 nt, Artificial Sequence
  Synthetic Oligonucleotide
ccaaacgauuggucuccccacaaacac

SEQ ID NO: 6180 - RNA, 27 nt, Artificial Sequence
  Synthetic Oligonucleotide
cccuuccacagccuccacaauuucugg

SEQ ID NO: 6181 - RNA, 27 nt, Artificial Sequence
  Synthetic Oligonucleotide
cuaaaggauacagcacuuuagccugcc

SEQ ID NO: 6182 - RNA, 27 nt, Artificial Sequence
  Synthetic Oligonucleotide
auauggccuuguagcccaucuucucug

SEQ ID NO: 6183 - RNA, 27 nt, Artificial Sequence
  Synthetic Oligonucleotide
ugccgcacuagcuucuuggugacuucu

SEQ ID NO: 6184 - RNA, 27 nt, Artificial Sequence
  Synthetic Oligonucleotide
ucacaguggcaagcucgccguccacau

SEQ ID NO: 6185 - RNA, 27 nt, Artificial Sequence
  Synthetic Oligonucleotide
ccagggacugacaggcucucacagugg

SEQ ID NO: 6186 - RNA, 27 nt, Artificial Sequence
  Synthetic Oligonucleotide
agguuccuaggacacccauugaaaagu

SEQ ID NO: 6187 - RNA, 27 nt, Artificial Sequence
  Synthetic Oligonucleotide
acauuccggagcauccuuggauacagc

SEQ ID NO: 6188 - RNA, 27 nt, Artificial Sequence
  Synthetic Oligonucleotide
ugaggagguggcccaggaacucaacau

SEQ ID NO: 6189 - RNA, 27 nt, Artificial Sequence
  Synthetic Oligonucleotide
gaucuuggaaacggccaaaggauuuuu

SEQ ID NO: 6190 - RNA, 27 nt, Artificial Sequence
  Synthetic Oligonucleotide
aaggauacagcacuuuagccugccagg

SEQ ID NO: 6191 - RNA, 27 nt, Artificial Sequence
  Synthetic Oligonucleotide
agaucuuggaaacggccaaaggauuuu

SEQ ID NO: 6192 - RNA, 27 nt, Artificial Sequence
  Synthetic Oligonucleotide
cuucccuuccacagccuccacaauuuc

SEQ ID NO: 6193 - RNA, 27 nt, Artificial Sequence
  Synthetic Oligonucleotide
accgccacccauuccaauucucuccag

SEQ ID NO: 6194 - RNA, 27 nt, Artificial Sequence
  Synthetic Oligonucleotide
ggagguggcccaggaacucaacaucau

SEQ ID NO: 6195 - RNA, 27 nt, Artificial Sequence
  Synthetic Oligonucleotide
agccuccacaauuucuggcagaacauc

SEQ ID NO: 6196 - RNA, 27 nt, Artificial Sequence
  Synthetic Oligonucleotide
ucuucucugccugccgcacuagcuucu

SEQ ID NO: 6197 - RNA, 27 nt, Artificial Sequence
  Synthetic Oligonucleotide
aucgaguugucgagccccaugauucga

SEQ ID NO: 6198 - RNA, 27 nt, Artificial Sequence
  Synthetic Oligonucleotide
aagccauguuuaacagccucccuggca

SEQ ID NO: 6199 - RNA, 27 nt, Artificial Sequence
  Synthetic Oligonucleotide
cgccacccauuccaauucucuccagug

SEQ ID NO: 6200 - RNA, 27 nt, Artificial Sequence
  Synthetic Oligonucleotide
uauggccuuguagcccaucuucucugc

SEQ ID NO: 6201 - RNA, 27 nt, Artificial Sequence
  Synthetic Oligonucleotide
aagcuaagccccaaacgauuggucucc

SEQ ID NO: 6202 - RNA, 27 nt, Artificial Sequence
  Synthetic Oligonucleotide
accuucccuuccacagccuccacaauu

SEQ ID NO: 6203 - RNA, 27 nt, Artificial Sequence
  Synthetic Oligonucleotide
caucgaguugucgagccccaugauucg

SEQ ID NO: 6204 - RNA, 27 nt, Artificial Sequence
  Synthetic Oligonucleotide
guugcagccaacgaagugccucaggac

SEQ ID NO: 6205 - RNA, 27 nt, Artificial Sequence
  Synthetic Oligonucleotide
ucaacaucaugcccguucccagggacu

SEQ ID NO: 6206 - RNA, 27 nt, Artificial Sequence
  Synthetic Oligonucleotide
ucccagggacugacaggcucucacagu

SEQ ID NO: 6207 - RNA, 27 nt, Artificial Sequence
  Synthetic Oligonucleotide
uaccgccacccauuccaauucucucca

SEQ ID NO: 6208 - RNA, 27 nt, Artificial Sequence
  Synthetic Oligonucleotide
cacauucuggcacccacucagagccau

SEQ ID NO: 6209 - RNA, 27 nt, Artificial Sequence
  Synthetic Oligonucleotide
cugccgcacuagcuucuuggugacuuc

SEQ ID NO: 6210 - RNA, 27 nt, Artificial Sequence
  Synthetic Oligonucleotide
ccauggccaaccggaauucuuccuuua

SEQ ID NO: 6211 - RNA, 27 nt, Artificial Sequence
  Synthetic Oligonucleotide
gcacugucagaucuuggaaacggccaa

SEQ ID NO: 6212 - RNA, 27 nt, Artificial Sequence
  Synthetic Oligonucleotide
ucagaucuuggaaacggccaaaggauu

SEQ ID NO: 6213 - RNA, 27 nt, Artificial Sequence
  Synthetic Oligonucleotide
cuuguagcccaucuucucugccugccg

SEQ ID NO: 6214 - RNA, 27 nt, Artificial Sequence
  Synthetic Oligonucleotide
guucccagggacugacaggcucucaca

SEQ ID NO: 6215 - RNA, 27 nt, Artificial Sequence
  Synthetic Oligonucleotide
cacagccuccacaauuucuggcagaac

SEQ ID NO: 6216 - RNA, 27 nt, Artificial Sequence
  Synthetic Oligonucleotide
cuucucugccugccgcacuagcuucuu

SEQ ID NO: 6217 - RNA, 27 nt, Artificial Sequence
  Synthetic Oligonucleotide
ccugaguuguggcggcaguuugaaucu

SEQ ID NO: 6218 - RNA, 27 nt, Artificial Sequence
  Synthetic Oligonucleotide
cccaaacgauuggucuccccacaaaca

SEQ ID NO: 6219 - RNA, 27 nt, Artificial Sequence
  Synthetic Oligonucleotide
ggcaugcugacccucuguccuaaaaca

SEQ ID NO: 6220 - RNA, 27 nt, Artificial Sequence
  Synthetic Oligonucleotide
ccguccaggaagacuuccaccuucccu

SEQ ID NO: 6221 - RNA, 27 nt, Artificial Sequence
  Synthetic Oligonucleotide
acggccaaaggauuuuuccucaccaau

SEQ ID NO: 6222 - RNA, 27 nt, Artificial Sequence
  Synthetic Oligonucleotide
uuagccugccaggggaugacguugucu

SEQ ID NO: 6223 - RNA, 27 nt, Artificial Sequence
  Synthetic Oligonucleotide
ccugccaggggaugacguugucuaaac

SEQ ID NO: 6224 - RNA, 27 nt, Artificial Sequence
  Synthetic Oligonucleotide
gaaacggccaaaggauuuuuccucacc

SEQ ID NO: 6225 - RNA, 27 nt, Artificial Sequence
  Synthetic Oligonucleotide
ccuuguagcccaucuucucugccugcc

SEQ ID NO: 6226 - RNA, 27 nt, Artificial Sequence
  Synthetic Oligonucleotide
cgccacuucuucaauugaggagguggc

SEQ ID NO: 6227 - RNA, 27 nt, Artificial Sequence
  Synthetic Oligonucleotide
gagguggcccaggaacucaacaucaug

SEQ ID NO: 6228 - RNA, 27 nt, Artificial Sequence
  Synthetic Oligonucleotide
uuaccgccacccauuccaauucucucc

SEQ ID NO: 6229 - RNA, 27 nt, Artificial Sequence
  Synthetic Oligonucleotide
cuuccgccacuucuucaauugaggagg

SEQ ID NO: 6230 - RNA, 27 nt, Artificial Sequence
  Synthetic Oligonucleotide
ccgccacccauuccaauucucuccagu

SEQ ID NO: 6231 - RNA, 27 nt, Artificial Sequence
  Synthetic Oligonucleotide
gauacagcacuuuagccugccagggga

SEQ ID NO: 6232 - RNA, 27 nt, Artificial Sequence
  Synthetic Oligonucleotide
cuuccaccuucccuuccacagccucca

SEQ ID NO: 6233 - RNA, 27 nt, Artificial Sequence
  Synthetic Oligonucleotide
acauucuggcacccacucagagccaug

SEQ ID NO: 6234 - RNA, 27 nt, Artificial Sequence
  Synthetic Oligonucleotide
ccugccgcacuagcuucuuggugacuu

SEQ ID NO: 6235 - RNA, 27 nt, Artificial Sequence
  Synthetic Oligonucleotide
caggaccagcuuccgccacuucuucaa

SEQ ID NO: 6236 - RNA, 27 nt, Artificial Sequence
  Synthetic Oligonucleotide
caauugaggagguggcccaggaacuca

SEQ ID NO: 6237 - RNA, 27 nt, Artificial Sequence
  Synthetic Oligonucleotide
aguugcagccaacgaagugccucagga

SEQ ID NO: 6238 - RNA, 27 nt, Artificial Sequence
  Synthetic Oligonucleotide
cuucaauugaggagguggcccaggaac

SEQ ID NO: 6239 - RNA, 27 nt, Artificial Sequence
  Synthetic Oligonucleotide
uccaccuucccuuccacagccuccaca

SEQ ID NO: 6240 - RNA, 27 nt, Artificial Sequence
  Synthetic Oligonucleotide
ucgagccccaugauucgacaccaagau

SEQ ID NO: 6241 - RNA, 27 nt, Artificial Sequence
  Synthetic Oligonucleotide
uuccaccuucccuuccacagccuccac

SEQ ID NO: 6242 - RNA, 27 nt, Artificial Sequence
  Synthetic Oligonucleotide
gccccaugauucgacaccaagauccca

SEQ ID NO: 6243 - RNA, 27 nt, Artificial Sequence
  Synthetic Oligonucleotide
cucaacaucaugcccguucccagggac

SEQ ID NO: 6244 - RNA, 27 nt, Artificial Sequence
  Synthetic Oligonucleotide
ccucccuggcaucaucaccucucaaaa

SEQ ID NO: 6245 - RNA, 27 nt, Artificial Sequence
  Synthetic Oligonucleotide
cgacaccaagaucccauucaagccaug

SEQ ID NO: 6246 - RNA, 27 nt, Artificial Sequence
  Synthetic Oligonucleotide
cauucuggcacccacucagagccaugg

SEQ ID NO: 6247 - RNA, 27 nt, Artificial Sequence
  Synthetic Oligonucleotide
acagccucccuggcaucaucaccucuc

SEQ ID NO: 6248 - RNA, 27 nt, Artificial Sequence
  Synthetic Oligonucleotide
gacaggcucucacaguggcaagcucgc

SEQ ID NO: 6249 - RNA, 27 nt, Artificial Sequence
  Synthetic Oligonucleotide
uugaggagguggcccaggaacucaaca

SEQ ID NO: 6250 - RNA, 27 nt, Artificial Sequence
  Synthetic Oligonucleotide
caggcucucacaguggcaagcucgccg

SEQ ID NO: 6251 - RNA, 27 nt, Artificial Sequence
  Synthetic Oligonucleotide
cacaguggcaagcucgccguccacaug

SEQ ID NO: 6252 - RNA, 27 nt, Artificial Sequence
  Synthetic Oligonucleotide
ccuucccuuccacagccuccacaauuu

SEQ ID NO: 6253 - RNA, 27 nt, Artificial Sequence
  Synthetic Oligonucleotide
ggaccagcuuccgccacuucuucaauu

SEQ ID NO: 6254 - RNA, 27 nt, Artificial Sequence
  Synthetic Oligonucleotide
uaguggcuggcaccccaucgaguuguc

SEQ ID NO: 6255 - RNA, 27 nt, Artificial Sequence
  Synthetic Oligonucleotide
gagccauggccaaccggaauucuuccu

SEQ ID NO: 6256 - RNA, 27 nt, Artificial Sequence
  Synthetic Oligonucleotide
uggccuuguagcccaucuucucugccu

SEQ ID NO: 6257 - RNA, 27 nt, Artificial Sequence
  Synthetic Oligonucleotide
ggaaagcuaagccccaaacgauugguc

SEQ ID NO: 6258 - RNA, 27 nt, Artificial Sequence
  Synthetic Oligonucleotide
ggaaacggccaaaggauuuuuccucac

SEQ ID NO: 6259 - RNA, 27 nt, Artificial Sequence
  Synthetic Oligonucleotide
acuuuagccugccaggggaugacguug

SEQ ID NO: 6260 - RNA, 27 nt, Artificial Sequence
  Synthetic Oligonucleotide
cccagggacugacaggcucucacagug

SEQ ID NO: 6261 - RNA, 27 nt, Artificial Sequence
  Synthetic Oligonucleotide
gcacuuuagccugccaggggaugacgu

SEQ ID NO: 6262 - RNA, 27 nt, Artificial Sequence
  Synthetic Oligonucleotide
uuuagccugccaggggaugacguuguc

SEQ ID NO: 6263 - RNA, 27 nt, Artificial Sequence
  Synthetic Oligonucleotide
ccaucgaguugucgagccccaugauuc

SEQ ID NO: 6264 - RNA, 27 nt, Artificial Sequence
  Synthetic Oligonucleotide
cagaucuuggaaacggccaaaggauuu

SEQ ID NO: 6265 - RNA, 27 nt, Artificial Sequence
  Synthetic Oligonucleotide
ggauacagcacuuuagccugccagggg

SEQ ID NO: 6266 - RNA, 27 nt, Artificial Sequence
  Synthetic Oligonucleotide
gucgagccccaugauucgacaccaaga

SEQ ID NO: 6267 - RNA, 27 nt, Artificial Sequence
  Synthetic Oligonucleotide
acaguggcaagcucgccguccacauga

SEQ ID NO: 6268 - RNA, 27 nt, Artificial Sequence
  Synthetic Oligonucleotide
ucagagccauggccaaccggaauucuu

SEQ ID NO: 6269 - RNA, 27 nt, Artificial Sequence
  Synthetic Oligonucleotide
cugccugccgcacuagcuucuugguga

SEQ ID NO: 6270 - RNA, 27 nt, Artificial Sequence
  Synthetic Oligonucleotide
ccccguccaggaagacuuccaccuucc

SEQ ID NO: 6271 - RNA, 27 nt, Artificial Sequence
  Synthetic Oligonucleotide
aggagguggcccaggaacucaacauca

SEQ ID NO: 6272 - RNA, 27 nt, Artificial Sequence
  Synthetic Oligonucleotide
ucauccagacgguugcccagguaaggu

SEQ ID NO: 6273 - RNA, 27 nt, Artificial Sequence
  Synthetic Oligonucleotide
aguggcuggcaccccaucgaguugucg

SEQ ID NO: 6274 - RNA, 27 nt, Artificial Sequence
  Synthetic Oligonucleotide
cagccucccuggcaucaucaccucuca

SEQ ID NO: 6275 - RNA, 27 nt, Artificial Sequence
  Synthetic Oligonucleotide
acgcacaucauccagacgguugcccag

SEQ ID NO: 6276 - RNA, 27 nt, Artificial Sequence
  Synthetic Oligonucleotide
aggauacagcacuuuagccugccaggg

SEQ ID NO: 6277 - RNA, 27 nt, Artificial Sequence
  Synthetic Oligonucleotide
acaggcucucacaguggcaagcucgcc

SEQ ID NO: 6278 - RNA, 27 nt, Artificial Sequence
  Synthetic Oligonucleotide
cucaggaccagcuuccgccacuucuuc

SEQ ID NO: 6279 - RNA, 27 nt, Artificial Sequence
  Synthetic Oligonucleotide
ccaucuucucugccugccgcacuagcu

SEQ ID NO: 6280 - RNA, 27 nt, Artificial Sequence
  Synthetic Oligonucleotide
ccccaaacgauuggucuccccacaaac

SEQ ID NO: 6281 - RNA, 27 nt, Artificial Sequence
  Synthetic Oligonucleotide
cucagagccauggccaaccggaauucu

SEQ ID NO: 6282 - RNA, 27 nt, Artificial Sequence
  Synthetic Oligonucleotide
agguggcccaggaacucaacaucaugc

SEQ ID NO: 6283 - RNA, 27 nt, Artificial Sequence
  Synthetic Oligonucleotide
uaacagccucccuggcaucaucaccuc

SEQ ID NO: 6284 - RNA, 27 nt, Artificial Sequence
  Synthetic Oligonucleotide
aucuucucugccugccgcacuagcuuc

SEQ ID NO: 6285 - RNA, 27 nt, Artificial Sequence
  Synthetic Oligonucleotide
auaguggcuggcaccccaucgaguugu

SEQ ID NO: 6286 - RNA, 27 nt, Artificial Sequence
  Synthetic Oligonucleotide
gcucucacaguggcaagcucgccgucc

SEQ ID NO: 6287 - RNA, 27 nt, Artificial Sequence
  Synthetic Oligonucleotide
gccauggccaaccggaauucuuccuuu

SEQ ID NO: 6288 - RNA, 27 nt, Artificial Sequence
  Synthetic Oligonucleotide
gcuggcaccccaucgaguugucgagcc

SEQ ID NO: 6289 - RNA, 27 nt, Artificial Sequence
  Synthetic Oligonucleotide
gccacccauuccaauucucuccagugc

SEQ ID NO: 6290 - RNA, 27 nt, Artificial Sequence
  Synthetic Oligonucleotide
aacagccucccuggcaucaucaccucu

SEQ ID NO: 6291 - RNA, 27 nt, Artificial Sequence
  Synthetic Oligonucleotide
ccacagccuccacaauuucuggcagaa

SEQ ID NO: 6292 - RNA, 27 nt, Artificial Sequence
  Synthetic Oligonucleotide
aggaccagcuuccgccacuucuucaau

SEQ ID NO: 6293 - RNA, 27 nt, Artificial Sequence
  Synthetic Oligonucleotide
agcuaagccccaaacgauuggucuccc

SEQ ID NO: 6294 - RNA, 27 nt, Artificial Sequence
  Synthetic Oligonucleotide
ucucacaguggcaagcucgccguccac

SEQ ID NO: 6295 - RNA, 27 nt, Artificial Sequence
  Synthetic Oligonucleotide
uccagacgguugcccagguaaggugug

SEQ ID NO: 6296 - RNA, 27 nt, Artificial Sequence
  Synthetic Oligonucleotide
agccccaugauucgacaccaagauccc

SEQ ID NO: 6297 - RNA, 27 nt, Artificial Sequence
  Synthetic Oligonucleotide
ucugccugccgcacuagcuucuuggug

SEQ ID NO: 6298 - RNA, 27 nt, Artificial Sequence
  Synthetic Oligonucleotide
auugaggagguggcccaggaacucaac

SEQ ID NO: 6299 - RNA, 27 nt, Artificial Sequence
  Synthetic Oligonucleotide
aacaucaugcccguucccagggacuga

SEQ ID NO: 6300 - RNA, 27 nt, Artificial Sequence
  Synthetic Oligonucleotide
uggcuggcaccccaucgaguugucgag

SEQ ID NO: 6301 - RNA, 27 nt, Artificial Sequence
  Synthetic Oligonucleotide
gagccccaugauucgacaccaagaucc

SEQ ID NO: 6302 - RNA, 27 nt, Artificial Sequence
  Synthetic Oligonucleotide
caucuucucugccugccgcacuagcuu

SEQ ID NO: 6303 - RNA, 27 nt, Artificial Sequence
  Synthetic Oligonucleotide
ggcucucacaguggcaagcucgccguc

SEQ ID NO: 6304 - RNA, 27 nt, Artificial Sequence
  Synthetic Oligonucleotide
caguugcagccaacgaagugccucagg

SEQ ID NO: 6305 - RNA, 27 nt, Artificial Sequence
  Synthetic Oligonucleotide
uggcccaggaacucaacaucaugcccg

SEQ ID NO: 6306 - RNA, 27 nt, Artificial Sequence
  Synthetic Oligonucleotide
aggcucucacaguggcaagcucgccgu

SEQ ID NO: 6307 - RNA, 27 nt, Artificial Sequence
  Synthetic Oligonucleotide
cguucccagggacugacaggcucucac

SEQ ID NO: 6308 - RNA, 27 nt, Artificial Sequence
  Synthetic Oligonucleotide
caucaugcccguucccagggacugaca

SEQ ID NO: 6309 - RNA, 27 nt, Artificial Sequence
  Synthetic Oligonucleotide
gugcacugucagaucuuggaaacggcc

SEQ ID NO: 6310 - RNA, 27 nt, Artificial Sequence
  Synthetic Oligonucleotide
auggccuuguagcccaucuucucugcc

SEQ ID NO: 6311 - RNA, 27 nt, Artificial Sequence
  Synthetic Oligonucleotide
gcccaggaacucaacaucaugcccguu

SEQ ID NO: 6312 - RNA, 27 nt, Artificial Sequence
  Synthetic Oligonucleotide
caucauccagacgguugcccagguaag

SEQ ID NO: 6313 - RNA, 27 nt, Artificial Sequence
  Synthetic Oligonucleotide
caacaucaugcccguucccagggacug

SEQ ID NO: 6314 - RNA, 27 nt, Artificial Sequence
  Synthetic Oligonucleotide
ccaacgaagugccucaggaccagcuuc

SEQ ID NO: 6315 - RNA, 27 nt, Artificial Sequence
  Synthetic Oligonucleotide
cccguccaggaagacuuccaccuuccc

SEQ ID NO: 6316 - RNA, 27 nt, Artificial Sequence
  Synthetic Oligonucleotide
acaucaugcccguucccagggacugac

SEQ ID NO: 6317 - RNA, 27 nt, Artificial Sequence
  Synthetic Oligonucleotide
ccguucccagggacugacaggcucuca

SEQ ID NO: 6318 - RNA, 27 nt, Artificial Sequence
  Synthetic Oligonucleotide
cauccagacgguugcccagguaaggug

SEQ ID NO: 6319 - RNA, 27 nt, Artificial Sequence
  Synthetic Oligonucleotide
accccaucgaguugucgagccccauga

SEQ ID NO: 6320 - RNA, 27 nt, Artificial Sequence
  Synthetic Oligonucleotide
cguccacaugagccaugcgcugcaugg

SEQ ID NO: 6321 - RNA, 27 nt, Artificial Sequence
  Synthetic Oligonucleotide
gcuaagccccaaacgauuggucucccc

SEQ ID NO: 6322 - RNA, 27 nt, Artificial Sequence
  Synthetic Oligonucleotide
acagcacuuuagccugccaggggauga

SEQ ID NO: 6323 - RNA, 27 nt, Artificial Sequence
  Synthetic Oligonucleotide
agccccaaacgauuggucuccccacaa

SEQ ID NO: 6324 - RNA, 27 nt, Artificial Sequence
  Synthetic Oligonucleotide
ucucugccugccgcacuagcuucuugg

SEQ ID NO: 6325 - RNA, 27 nt, Artificial Sequence
  Synthetic Oligonucleotide
cuuuagccugccaggggaugacguugu

SEQ ID NO: 6326 - RNA, 27 nt, Artificial Sequence
  Synthetic Oligonucleotide
ggcccaggaacucaacaucaugcccgu

SEQ ID NO: 6327 - RNA, 27 nt, Artificial Sequence
  Synthetic Oligonucleotide
gccucccuggcaucaucaccucucaaa

SEQ ID NO: 6328 - RNA, 27 nt, Artificial Sequence
  Synthetic Oligonucleotide
cgccaagagccagagcuuucagaacau

SEQ ID NO: 6329 - RNA, 27 nt, Artificial Sequence
  Synthetic Oligonucleotide
cucacaguggcaagcucgccguccaca

SEQ ID NO: 6330 - RNA, 27 nt, Artificial Sequence
  Synthetic Oligonucleotide
caagccauguuuaacagccucccuggc

SEQ ID NO: 6331 - RNA, 27 nt, Artificial Sequence
  Synthetic Oligonucleotide
agccugccaggggaugacguugucuaa

SEQ ID NO: 6332 - RNA, 27 nt, Artificial Sequence
  Synthetic Oligonucleotide
cgcacaucauccagacgguugcccagg

SEQ ID NO: 6333 - RNA, 27 nt, Artificial Sequence
  Synthetic Oligonucleotide
uacagcacuuuagccugccaggggaug

SEQ ID NO: 6334 - DNA, 27 bp, Artificial Sequence
  Synthetic Oligonucleotide
ctggaaatatattaactgttaaaaaga

SEQ ID NO: 6335 - DNA, 27 bp, Artificial Sequence
  Synthetic Oligonucleotide
taatgatctcattgtttattaacctgt

SEQ ID NO: 6336 - DNA, 27 bp, Artificial Sequence
  Synthetic Oligonucleotide
aagataatgatctcattgtttattaac

SEQ ID NO: 6337 - DNA, 27 bp, Artificial Sequence
  Synthetic Oligonucleotide
tggaaatatattaactgttaaaaagaa

SEQ ID NO: 6338 - DNA, 27 bp, Artificial Sequence
  Synthetic Oligonucleotide
ttcagcatgtattacttgacaaagaga

SEQ ID NO: 6339 - DNA, 27 bp, Artificial Sequence
  Synthetic Oligonucleotide
tcctggaaatatattaactgttaaaaa

SEQ ID NO: 6340 - DNA, 27 bp, Artificial Sequence
  Synthetic Oligonucleotide
aaagataatgatctcattgtttattaa

SEQ ID NO: 6341 - DNA, 27 bp, Artificial Sequence
  Synthetic Oligonucleotide
aaattttgaaaccagtactttatcatt

SEQ ID NO: 6342 - DNA, 27 bp, Artificial Sequence
  Synthetic Oligonucleotide
ttgaaaccagtactttatcattttctc

SEQ ID NO: 6343 - DNA, 27 bp, Artificial Sequence
  Synthetic Oligonucleotide
cctggaaatatattaactgttaaaaag

SEQ ID NO: 6344 - DNA, 27 bp, Artificial Sequence
  Synthetic Oligonucleotide
aacaaaatagcaatcccttttatttca

SEQ ID NO: 6345 - DNA, 27 bp, Artificial Sequence
  Synthetic Oligonucleotide
ataatgatctcattgtttattaacctg

SEQ ID NO: 6346 - DNA, 27 bp, Artificial Sequence
  Synthetic Oligonucleotide
aacagtggttcttaaattgtaagctca

SEQ ID NO: 6347 - DNA, 27 bp, Artificial Sequence
  Synthetic Oligonucleotide
ggactttcatcctggaaatatattaac

SEQ ID NO: 6348 - DNA, 27 bp, Artificial Sequence
  Synthetic Oligonucleotide
ttatgaacaacatgctaaatcagtact

SEQ ID NO: 6349 - DNA, 27 bp, Artificial Sequence
  Synthetic Oligonucleotide
gtgaaaagataatgatctcattgttta

SEQ ID NO: 6350 - DNA, 27 bp, Artificial Sequence
  Synthetic Oligonucleotide
tggtgatacttctttgaatgtagattt

SEQ ID NO: 6351 - DNA, 27 bp, Artificial Sequence
  Synthetic Oligonucleotide
agaagactgacatcattgccaattgtt

SEQ ID NO: 6352 - DNA, 27 bp, Artificial Sequence
  Synthetic Oligonucleotide
tggactttcatcctggaaatatattaa

SEQ ID NO: 6353 - DNA, 27 bp, Artificial Sequence
  Synthetic Oligonucleotide
tcatcctggaaatatattaactgttaa

SEQ ID NO: 6354 - DNA, 27 bp, Artificial Sequence
  Synthetic Oligonucleotide
gagaagactgacatcattgccaattgt

SEQ ID NO: 6355 - DNA, 27 bp, Artificial Sequence
  Synthetic Oligonucleotide
aattggtgatacttctttgaatgtaga

SEQ ID NO: 6356 - DNA, 27 bp, Artificial Sequence
  Synthetic Oligonucleotide
ctcattgtttattaacctgtattctgt

SEQ ID NO: 6357 - DNA, 27 bp, Artificial Sequence
  Synthetic Oligonucleotide
aggtgaaaagataatgatctcattgtt

SEQ ID NO: 6358 - DNA, 27 bp, Artificial Sequence
  Synthetic Oligonucleotide
tttcatcctggaaatatattaactgtt

SEQ ID NO: 6359 - DNA, 27 bp, Artificial Sequence
  Synthetic Oligonucleotide
acaaaatagcaatcccttttatttcat

SEQ ID NO: 6360 - DNA, 27 bp, Artificial Sequence
  Synthetic Oligonucleotide
agataatgatctcattgtttattaacc

SEQ ID NO: 6361 - DNA, 27 bp, Artificial Sequence
  Synthetic Oligonucleotide
ctttcatcctggaaatatattaactgt

SEQ ID NO: 6362 - DNA, 27 bp, Artificial Sequence
  Synthetic Oligonucleotide
tagcaatcccttttatttcattgcttt

SEQ ID NO: 6363 - DNA, 27 bp, Artificial Sequence
  Synthetic Oligonucleotide
caaaatagcaatcccttttatttcatt

SEQ ID NO: 6364 - DNA, 27 bp, Artificial Sequence
  Synthetic Oligonucleotide
tcagcatgtattacttgacaaagagac

SEQ ID NO: 6365 - DNA, 27 bp, Artificial Sequence
  Synthetic Oligonucleotide
gtaattggtgatacttctttgaatgta

SEQ ID NO: 6366 - DNA, 27 bp, Artificial Sequence
  Synthetic Oligonucleotide
gggatagcaataacctgtgaaaatgct

SEQ ID NO: 6367 - DNA, 27 bp, Artificial Sequence
  Synthetic Oligonucleotide
tcattgtttattaacctgtattctgtt

SEQ ID NO: 6368 - DNA, 27 bp, Artificial Sequence
  Synthetic Oligonucleotide
cacaactcaggatgaaaaattttgaaa

SEQ ID NO: 6369 - DNA, 27 bp, Artificial Sequence
  Synthetic Oligonucleotide
ttcatcctggaaatatattaactgtta

SEQ ID NO: 6370 - DNA, 27 bp, Artificial Sequence
  Synthetic Oligonucleotide
tgggatagcaataacctgtgaaaatgc

SEQ ID NO: 6371 - DNA, 27 bp, Artificial Sequence
  Synthetic Oligonucleotide
taattggtgatacttctttgaatgtag

SEQ ID NO: 6372 - DNA, 27 bp, Artificial Sequence
  Synthetic Oligonucleotide
atgaaaaattttgaaaccagtacttta

SEQ ID NO: 6373 - DNA, 27 bp, Artificial Sequence
  Synthetic Oligonucleotide
aatttgtatcaatgattatgaacaaca

SEQ ID NO: 6374 - DNA, 27 bp, Artificial Sequence
  Synthetic Oligonucleotide
ggctaatttgtatcaatgattatgaac

SEQ ID NO: 6375 - DNA, 27 bp, Artificial Sequence
  Synthetic Oligonucleotide
gtctgaatatatccaaatgttttagga

SEQ ID NO: 6376 - DNA, 27 bp, Artificial Sequence
  Synthetic Oligonucleotide
aaacagtggttcttaaattgtaagctc

SEQ ID NO: 6377 - DNA, 27 bp, Artificial Sequence
  Synthetic Oligonucleotide
tgatctcattgtttattaacctgtatt

SEQ ID NO: 6378 - DNA, 27 bp, Artificial Sequence
  Synthetic Oligonucleotide
tctcattgtttattaacctgtattctg

SEQ ID NO: 6379 - DNA, 27 bp, Artificial Sequence
  Synthetic Oligonucleotide
tttttttcagcatgtattacttgacaa

SEQ ID NO: 6380 - DNA, 27 bp, Artificial Sequence
  Synthetic Oligonucleotide
aaccagtactttatcattttctcctga

SEQ ID NO: 6381 - DNA, 27 bp, Artificial Sequence
  Synthetic Oligonucleotide
gtaatgcctgattcacaactttgagaa

SEQ ID NO: 6382 - DNA, 27 bp, Artificial Sequence
  Synthetic Oligonucleotide
aaaattttgaaaccagtactttatcat

SEQ ID NO: 6383 - DNA, 27 bp, Artificial Sequence
  Synthetic Oligonucleotide
atagcaatcccttttatttcattgctt

SEQ ID NO: 6384 - DNA, 27 bp, Artificial Sequence
  Synthetic Oligonucleotide
cggctaatttgtatcaatgattatgaa

SEQ ID NO: 6385 - DNA, 27 bp, Artificial Sequence
  Synthetic Oligonucleotide
atcctggaaatatattaactgttaaaa

SEQ ID NO: 6386 - DNA, 27 bp, Artificial Sequence
  Synthetic Oligonucleotide
aaaagataatgatctcattgtttatta

SEQ ID NO: 6387 - DNA, 27 bp, Artificial Sequence
  Synthetic Oligonucleotide
ctgaatatatccaaatgttttaggatg

SEQ ID NO: 6388 - DNA, 27 bp, Artificial Sequence
  Synthetic Oligonucleotide
taatttgtatcaatgattatgaacaac

SEQ ID NO: 6389 - DNA, 27 bp, Artificial Sequence
  Synthetic Oligonucleotide
actgacatcattgccaattgttgcaaa

SEQ ID NO: 6390 - DNA, 27 bp, Artificial Sequence
  Synthetic Oligonucleotide
aatgattatgaacaacatgctaaatca

SEQ ID NO: 6391 - DNA, 27 bp, Artificial Sequence
  Synthetic Oligonucleotide
aaaatagcaatcccttttatttcattg

SEQ ID NO: 6392 - DNA, 27 bp, Artificial Sequence
  Synthetic Oligonucleotide
ggatagcaataacctgtgaaaatgctc

SEQ ID NO: 6393 - DNA, 27 bp, Artificial Sequence
  Synthetic Oligonucleotide
gctaatttgtatcaatgattatgaaca

SEQ ID NO: 6394 - DNA, 27 bp, Artificial Sequence
  Synthetic Oligonucleotide
tgaacaacatgctaaatcagtacttcc

SEQ ID NO: 6395 - DNA, 27 bp, Artificial Sequence
  Synthetic Oligonucleotide
ttatttcattgcttttgacttttcaat

SEQ ID NO: 6396 - DNA, 27 bp, Artificial Sequence
  Synthetic Oligonucleotide
aaattgtaagctcaggttcaaagtgtt

SEQ ID NO: 6397 - DNA, 27 bp, Artificial Sequence
  Synthetic Oligonucleotide
gactgacatcattgccaattgttgcaa

SEQ ID NO: 6398 - DNA, 27 bp, Artificial Sequence
  Synthetic Oligonucleotide
aatgatctcattgtttattaacctgta

SEQ ID NO: 6399 - DNA, 27 bp, Artificial Sequence
  Synthetic Oligonucleotide
tgattatgaacaacatgctaaatcagt

SEQ ID NO: 6400 - DNA, 27 bp, Artificial Sequence
  Synthetic Oligonucleotide
aaatggactttcatcctggaaatatat

SEQ ID NO: 6401 - DNA, 27 bp, Artificial Sequence
  Synthetic Oligonucleotide
aaagtgttggtaatgcctgattcacaa

SEQ ID NO: 6402 - DNA, 27 bp, Artificial Sequence
  Synthetic Oligonucleotide
ttgtatcaatgattatgaacaacatgc

SEQ ID NO: 6403 - DNA, 27 bp, Artificial Sequence
  Synthetic Oligonucleotide
caatcccttttatttcattgcttttga

SEQ ID NO: 6404 - DNA, 27 bp, Artificial Sequence
  Synthetic Oligonucleotide
cggtaattggtgatacttctttgaatg

SEQ ID NO: 6405 - DNA, 27 bp, Artificial Sequence
  Synthetic Oligonucleotide
tcgacaagacattggtgaggaaaaatc

SEQ ID NO: 6406 - DNA, 27 bp, Artificial Sequence
  Synthetic Oligonucleotide
aatagcaatcccttttatttcattgct

SEQ ID NO: 6407 - DNA, 27 bp, Artificial Sequence
  Synthetic Oligonucleotide
tgttggtaatgcctgattcacaacttt

SEQ ID NO: 6408 - DNA, 27 bp, Artificial Sequence
  Synthetic Oligonucleotide
atattaactgttaaaaagaaaacattg

SEQ ID NO: 6409 - DNA, 27 bp, Artificial Sequence
  Synthetic Oligonucleotide
ctcaggatgaaaaattttgaaaccagt

SEQ ID NO: 6410 - DNA, 27 bp, Artificial Sequence
  Synthetic Oligonucleotide
ctgggatagcaataacctgtgaaaatg

SEQ ID NO: 6411 - DNA, 27 bp, Artificial Sequence
  Synthetic Oligonucleotide
aaaaattttgaaaccagtactttatca

SEQ ID NO: 6412 - DNA, 27 bp, Artificial Sequence
  Synthetic Oligonucleotide
ttggtgatacttctttgaatgtagatt

SEQ ID NO: 6413 - DNA, 27 bp, Artificial Sequence
  Synthetic Oligonucleotide
tatcaatgattatgaacaacatgctaa

SEQ ID NO: 6414 - DNA, 27 bp, Artificial Sequence
  Synthetic Oligonucleotide
gtaagctcaggttcaaagtgttggtaa

SEQ ID NO: 6415 - DNA, 27 bp, Artificial Sequence
  Synthetic Oligonucleotide
ctaatttgtatcaatgattatgaacaa

SEQ ID NO: 6416 - DNA, 27 bp, Artificial Sequence
  Synthetic Oligonucleotide
tatttcattgcttttgacttttcaatg

SEQ ID NO: 6417 - DNA, 27 bp, Artificial Sequence
  Synthetic Oligonucleotide
tctgaatatatccaaatgttttaggat

SEQ ID NO: 6418 - DNA, 27 bp, Artificial Sequence
  Synthetic Oligonucleotide
atgattatgaacaacatgctaaatcag

SEQ ID NO: 6419 - DNA, 27 bp, Artificial Sequence
  Synthetic Oligonucleotide
atatattaactgttaaaaagaaaacat

SEQ ID NO: 6420 - DNA, 27 bp, Artificial Sequence
  Synthetic Oligonucleotide
gttggtaatgcctgattcacaactttg

SEQ ID NO: 6421 - DNA, 27 bp, Artificial Sequence
  Synthetic Oligonucleotide
aggatgaaaaattttgaaaccagtact

SEQ ID NO: 6422 - DNA, 27 bp, Artificial Sequence
  Synthetic Oligonucleotide
ttttgaaaccagtactttatcattttc

SEQ ID NO: 6423 - DNA, 27 bp, Artificial Sequence
  Synthetic Oligonucleotide
ttccaaagtctatatatgactattaca

SEQ ID NO: 6424 - DNA, 27 bp, Artificial Sequence
  Synthetic Oligonucleotide
aactcaggatgaaaaattttgaaacca

SEQ ID NO: 6425 - DNA, 27 bp, Artificial Sequence
  Synthetic Oligonucleotide
ttattaacctgtattctgtttacatgt

SEQ ID NO: 6426 - DNA, 27 bp, Artificial Sequence
  Synthetic Oligonucleotide
tttcagcatgtattacttgacaaagag

SEQ ID NO: 6427 - DNA, 27 bp, Artificial Sequence
  Synthetic Oligonucleotide
cacaatattttcccatctgtattattt

SEQ ID NO: 6428 - DNA, 27 bp, Artificial Sequence
  Synthetic Oligonucleotide
gtctgtaattccccacttcaatacaaa

SEQ ID NO: 6429 - DNA, 27 bp, Artificial Sequence
  Synthetic Oligonucleotide
tcaaagtgttggtaatgcctgattcac

SEQ ID NO: 6430 - DNA, 27 bp, Artificial Sequence
  Synthetic Oligonucleotide
taaagtgctgtatcctttagtaaaatt

SEQ ID NO: 6431 - DNA, 27 bp, Artificial Sequence
  Synthetic Oligonucleotide
gactttcatcctggaaatatattaact

SEQ ID NO: 6432 - DNA, 27 bp, Artificial Sequence
  Synthetic Oligonucleotide
ctggatgatgtgcgtaacagattcaaa

SEQ ID NO: 6433 - DNA, 27 bp, Artificial Sequence
  Synthetic Oligonucleotide
tgtgaaagtcatcgacaagacattggt

SEQ ID NO: 6434 - DNA, 27 bp, Artificial Sequence
  Synthetic Oligonucleotide
actcaggatgaaaaattttgaaaccag

SEQ ID NO: 6435 - DNA, 27 bp, Artificial Sequence
  Synthetic Oligonucleotide
ggaaatatattaactgttaaaaagaaa

SEQ ID NO: 6436 - DNA, 27 bp, Artificial Sequence
  Synthetic Oligonucleotide
tttttcagcatgtattacttgacaaag

SEQ ID NO: 6437 - DNA, 27 bp, Artificial Sequence
  Synthetic Oligonucleotide
ttttcagcatgtattacttgacaaaga

SEQ ID NO: 6438 - DNA, 27 bp, Artificial Sequence
  Synthetic Oligonucleotide
tgcacaatattttcccatctgtattat

SEQ ID NO: 6439 - DNA, 27 bp, Artificial Sequence
  Synthetic Oligonucleotide
caaacactaaggtgaaaagataatgat

SEQ ID NO: 6440 - DNA, 27 bp, Artificial Sequence
  Synthetic Oligonucleotide
agaatgtgaaagtcatcgacaagacat

SEQ ID NO: 6441 - DNA, 27 bp, Artificial Sequence
  Synthetic Oligonucleotide
tgaaaaattttgaaaccagtactttat

SEQ ID NO: 6442 - DNA, 27 bp, Artificial Sequence
  Synthetic Oligonucleotide
atggactttcatcctggaaatatatta

SEQ ID NO: 6443 - DNA, 27 bp, Artificial Sequence
  Synthetic Oligonucleotide
taaattgtaagctcaggttcaaagtgt

SEQ ID NO: 6444 - DNA, 27 bp, Artificial Sequence
  Synthetic Oligonucleotide
catcctggaaatatattaactgttaaa

SEQ ID NO: 6445 - DNA, 27 bp, Artificial Sequence
  Synthetic Oligonucleotide
tatattaactgttaaaaagaaaacatt

SEQ ID NO: 6446 - DNA, 27 bp, Artificial Sequence
  Synthetic Oligonucleotide
aatcccttttatttcattgcttttgac

SEQ ID NO: 6447 - DNA, 27 bp, Artificial Sequence
  Synthetic Oligonucleotide
atccaaatgttttaggatgtatgttac

SEQ ID NO: 6448 - DNA, 27 bp, Artificial Sequence
  Synthetic Oligonucleotide
ctgttaaaaagaaaacattgaaaatgt

SEQ ID NO: 6449 - DNA, 27 bp, Artificial Sequence
  Synthetic Oligonucleotide
agactgacatcattgccaattgttgca

SEQ ID NO: 6450 - DNA, 27 bp, Artificial Sequence
  Synthetic Oligonucleotide
tttgaaaccagtactttatcattttct

SEQ ID NO: 6451 - DNA, 27 bp, Artificial Sequence
  Synthetic Oligonucleotide
cactattgatgttctgccagaaattgt

SEQ ID NO: 6452 - DNA, 27 bp, Artificial Sequence
  Synthetic Oligonucleotide
gaaatatattaactgttaaaaagaaaa

SEQ ID NO: 6453 - DNA, 27 bp, Artificial Sequence
  Synthetic Oligonucleotide
atcccttttatttcattgcttttgact

SEQ ID NO: 6454 - DNA, 27 bp, Artificial Sequence
  Synthetic Oligonucleotide
atctcattgtttattaacctgtattct

SEQ ID NO: 6455 - DNA, 27 bp, Artificial Sequence
  Synthetic Oligonucleotide
tggatgatgtgcgtaacagattcaaac

SEQ ID NO: 6456 - DNA, 27 bp, Artificial Sequence
  Synthetic Oligonucleotide
gaaatggactttcatcctggaaatata

SEQ ID NO: 6457 - DNA, 27 bp, Artificial Sequence
  Synthetic Oligonucleotide
aattttgaaaccagtactttatcattt

SEQ ID NO: 6458 - DNA, 27 bp, Artificial Sequence
  Synthetic Oligonucleotide
ccacaactcaggatgaaaaattttgaa

SEQ ID NO: 6459 - DNA, 27 bp, Artificial Sequence
  Synthetic Oligonucleotide
agcatgtattacttgacaaagagacac

SEQ ID NO: 6460 - DNA, 27 bp, Artificial Sequence
  Synthetic Oligonucleotide
ttaaattgtaagctcaggttcaaagtg

SEQ ID NO: 6461 - DNA, 27 bp, Artificial Sequence
  Synthetic Oligonucleotide
ttgtttattaacctgtattctgtttac

SEQ ID NO: 6462 - DNA, 27 bp, Artificial Sequence
  Synthetic Oligonucleotide
tgaaaccagtactttatcattttctcc

SEQ ID NO: 6463 - DNA, 27 bp, Artificial Sequence
  Synthetic Oligonucleotide
cagaatgtgaaagtcatcgacaagaca

SEQ ID NO: 6464 - DNA, 27 bp, Artificial Sequence
  Synthetic Oligonucleotide
gtatcaatgattatgaacaacatgcta

SEQ ID NO: 6465 - DNA, 27 bp, Artificial Sequence
  Synthetic Oligonucleotide
gataatgatctcattgtttattaacct

SEQ ID NO: 6466 - DNA, 27 bp, Artificial Sequence
  Synthetic Oligonucleotide
ctgtattctgtttacatgtctttaaaa

SEQ ID NO: 6467 - DNA, 27 bp, Artificial Sequence
  Synthetic Oligonucleotide
caatattttcccatctgtattattttt

SEQ ID NO: 6468 - DNA, 27 bp, Artificial Sequence
  Synthetic Oligonucleotide
ttagtgtctgaatatatccaaatgttt

SEQ ID NO: 6469 - DNA, 27 bp, Artificial Sequence
  Synthetic Oligonucleotide
gcacaatattttcccatctgtattatt

SEQ ID NO: 6470 - DNA, 27 bp, Artificial Sequence
  Synthetic Oligonucleotide
gtcgttcttttccaacaaaatagcaat

SEQ ID NO: 6471 - DNA, 27 bp, Artificial Sequence
  Synthetic Oligonucleotide
ctgacatcattgccaattgttgcaaag

SEQ ID NO: 6472 - DNA, 27 bp, Artificial Sequence
  Synthetic Oligonucleotide
aagtgttggtaatgcctgattcacaac

SEQ ID NO: 6473 - DNA, 27 bp, Artificial Sequence
  Synthetic Oligonucleotide
gaagactgacatcattgccaattgttg

SEQ ID NO: 6474 - DNA, 27 bp, Artificial Sequence
  Synthetic Oligonucleotide
gaaaagataatgatctcattgtttatt

SEQ ID NO: 6475 - DNA, 27 bp, Artificial Sequence
  Synthetic Oligonucleotide
acaactcaggatgaaaaattttgaaac

SEQ ID NO: 6476 - DNA, 27 bp, Artificial Sequence
  Synthetic Oligonucleotide
ctgataatattgcagcattttccagat

SEQ ID NO: 6477 - DNA, 27 bp, Artificial Sequence
  Synthetic Oligonucleotide
gaaaccagtactttatcattttctcct

SEQ ID NO: 6478 - DNA, 27 bp, Artificial Sequence
  Synthetic Oligonucleotide
acaatattttcccatctgtattatttt

SEQ ID NO: 6479 - DNA, 27 bp, Artificial Sequence
  Synthetic Oligonucleotide
accagtactttatcattttctcctgag

SEQ ID NO: 6480 - DNA, 27 bp, Artificial Sequence
  Synthetic Oligonucleotide
atcagtacttccaaagtctatatatga

SEQ ID NO: 6481 - DNA, 27 bp, Artificial Sequence
  Synthetic Oligonucleotide
cactaaggtgaaaagataatgatctca

SEQ ID NO: 6482 - DNA, 27 bp, Artificial Sequence
  Synthetic Oligonucleotide
taagctcaggttcaaagtgttggtaat

SEQ ID NO: 6483 - DNA, 27 bp, Artificial Sequence
  Synthetic Oligonucleotide
ggctgagaagactgacatcattgccaa

SEQ ID NO: 6484 - DNA, 27 bp, Artificial Sequence
  Synthetic Oligonucleotide
aaggtgaaaagataatgatctcattgt

SEQ ID NO: 6485 - DNA, 27 bp, Artificial Sequence
  Synthetic Oligonucleotide
ccagaatgtgaaagtcatcgacaagac

SEQ ID NO: 6486 - DNA, 27 bp, Artificial Sequence
  Synthetic Oligonucleotide
cagcatgtattacttgacaaagagaca

SEQ ID NO: 6487 - DNA, 27 bp, Artificial Sequence
  Synthetic Oligonucleotide
ttcattgcttttgacttttcaatgggt

SEQ ID NO: 6488 - DNA, 27 bp, Artificial Sequence
  Synthetic Oligonucleotide
actaaggtgaaaagataatgatctcat

SEQ ID NO: 6489 - DNA, 27 bp, Artificial Sequence
  Synthetic Oligonucleotide
tgcctgattcacaactttgagaaggta

SEQ ID NO: 6490 - DNA, 27 bp, Artificial Sequence
  Synthetic Oligonucleotide
agcaatcccttttatttcattgctttt

SEQ ID NO: 6491 - DNA, 27 bp, Artificial Sequence
  Synthetic Oligonucleotide
tttatttcattgcttttgacttttcaa

SEQ ID NO: 6492 - DNA, 27 bp, Artificial Sequence
  Synthetic Oligonucleotide
cagtctgtaattccccacttcaataca

SEQ ID NO: 6493 - DNA, 27 bp, Artificial Sequence
  Synthetic Oligonucleotide
ggtgatacttctttgaatgtagatttc

SEQ ID NO: 6494 - DNA, 27 bp, Artificial Sequence
  Synthetic Oligonucleotide
atcaatgattatgaacaacatgctaaa

SEQ ID NO: 6495 - DNA, 27 bp, Artificial Sequence
  Synthetic Oligonucleotide
aagtgctgtatcctttagtaaaattgg

SEQ ID NO: 6496 - DNA, 27 bp, Artificial Sequence
  Synthetic Oligonucleotide
gtgtcgttcttttccaacaaaatagca

SEQ ID NO: 6497 - DNA, 27 bp, Artificial Sequence
  Synthetic Oligonucleotide
caacaaaatagcaatcccttttatttc

SEQ ID NO: 6498 - DNA, 27 bp, Artificial Sequence
  Synthetic Oligonucleotide
agtctgtaattccccacttcaatacaa

SEQ ID NO: 6499 - DNA, 27 bp, Artificial Sequence
  Synthetic Oligonucleotide
tgaaagtcatcgacaagacattggtga

SEQ ID NO: 6500 - DNA, 27 bp, Artificial Sequence
  Synthetic Oligonucleotide
tgtttattaacctgtattctgtttaca

SEQ ID NO: 6501 - DNA, 27 bp, Artificial Sequence
  Synthetic Oligonucleotide
gtatgttacttcttagagagaaataaa

SEQ ID NO: 6502 - DNA, 27 bp, Artificial Sequence
  Synthetic Oligonucleotide
tatccaaatgttttaggatgtatgtta

SEQ ID NO: 6503 - DNA, 27 bp, Artificial Sequence
  Synthetic Oligonucleotide
tggttcttaaattgtaagctcaggttc

SEQ ID NO: 6504 - DNA, 27 bp, Artificial Sequence
  Synthetic Oligonucleotide
tccaacaaaatagcaatcccttttatt

SEQ ID NO: 6505 - DNA, 27 bp, Artificial Sequence
  Synthetic Oligonucleotide
atgaacaacatgctaaatcagtacttc

SEQ ID NO: 6506 - DNA, 27 bp, Artificial Sequence
  Synthetic Oligonucleotide
gcaaacactaaggtgaaaagataatga

SEQ ID NO: 6507 - DNA, 27 bp, Artificial Sequence
  Synthetic Oligonucleotide
ccggctaatttgtatcaatgattatga

SEQ ID NO: 6508 - DNA, 27 bp, Artificial Sequence
  Synthetic Oligonucleotide
aaatagcaatcccttttatttcattgc

SEQ ID NO: 6509 - DNA, 27 bp, Artificial Sequence
  Synthetic Oligonucleotide
aatggactttcatcctggaaatatatt

SEQ ID NO: 6510 - DNA, 27 bp, Artificial Sequence
  Synthetic Oligonucleotide
tggctgataatattgcagcattttcca

SEQ ID NO: 6511 - DNA, 27 bp, Artificial Sequence
  Synthetic Oligonucleotide
ccaacaaaatagcaatcccttttattt

SEQ ID NO: 6512 - DNA, 27 bp, Artificial Sequence
  Synthetic Oligonucleotide
aaatgttttaggatgtatgttacttct

SEQ ID NO: 6513 - DNA, 27 bp, Artificial Sequence
  Synthetic Oligonucleotide
tttagtgtctgaatatatccaaatgtt

SEQ ID NO: 6514 - DNA, 27 bp, Artificial Sequence
  Synthetic Oligonucleotide
tcccttttatttcattgcttttgactt

SEQ ID NO: 6515 - DNA, 27 bp, Artificial Sequence
  Synthetic Oligonucleotide
gtgtctgaatatatccaaatgttttag

SEQ ID NO: 6516 - DNA, 27 bp, Artificial Sequence
  Synthetic Oligonucleotide
gccagaatgtgaaagtcatcgacaaga

SEQ ID NO: 6517 - DNA, 27 bp, Artificial Sequence
  Synthetic Oligonucleotide
gaaaaattttgaaaccagtactttatc

SEQ ID NO: 6518 - DNA, 27 bp, Artificial Sequence
  Synthetic Oligonucleotide
ttttttcagcatgtattacttgacaaa

SEQ ID NO: 6519 - DNA, 27 bp, Artificial Sequence
  Synthetic Oligonucleotide
tgtctgaatatatccaaatgttttagg

SEQ ID NO: 6520 - DNA, 27 bp, Artificial Sequence
  Synthetic Oligonucleotide
ggatgaaaaattttgaaaccagtactt

SEQ ID NO: 6521 - DNA, 27 bp, Artificial Sequence
  Synthetic Oligonucleotide
tcaggatgaaaaattttgaaaccagta

SEQ ID NO: 6522 - DNA, 27 bp, Artificial Sequence
  Synthetic Oligonucleotide
tccaaagtctatatatgactattacag

SEQ ID NO: 6523 - DNA, 27 bp, Artificial Sequence
  Synthetic Oligonucleotide
tagtgtctgaatatatccaaatgtttt

SEQ ID NO: 6524 - DNA, 27 bp, Artificial Sequence
  Synthetic Oligonucleotide
caatgattatgaacaacatgctaaatc

SEQ ID NO: 6525 - DNA, 27 bp, Artificial Sequence
  Synthetic Oligonucleotide
tgttaaaaagaaaacattgaaaatgtg

SEQ ID NO: 6526 - DNA, 27 bp, Artificial Sequence
  Synthetic Oligonucleotide
ggtgaaaagataatgatctcattgttt

SEQ ID NO: 6527 - DNA, 27 bp, Artificial Sequence
  Synthetic Oligonucleotide
tgtcgttcttttccaacaaaatagcaa

SEQ ID NO: 6528 - DNA, 27 bp, Artificial Sequence
  Synthetic Oligonucleotide
agtgctgtatcctttagtaaaattgga

SEQ ID NO: 6529 - DNA, 27 bp, Artificial Sequence
  Synthetic Oligonucleotide
aaagtgctgtatcctttagtaaaattg

SEQ ID NO: 6530 - DNA, 27 bp, Artificial Sequence
  Synthetic Oligonucleotide
caaagtctatatatgactattacaggt

SEQ ID NO: 6531 - DNA, 27 bp, Artificial Sequence
  Synthetic Oligonucleotide
ttcaaagtgttggtaatgcctgattca

SEQ ID NO: 6532 - DNA, 27 bp, Artificial Sequence
  Synthetic Oligonucleotide
gcggtaattggtgatacttctttgaat

SEQ ID NO: 6533 - DNA, 27 bp, Artificial Sequence
  Synthetic Oligonucleotide
tccaaatgttttaggatgtatgttact

SEQ ID NO: 6534 - DNA, 27 bp, Artificial Sequence
  Synthetic Oligonucleotide
tgatacttctttgaatgtagatttcca

SEQ ID NO: 6535 - DNA, 27 bp, Artificial Sequence
  Synthetic Oligonucleotide
atgatctcattgtttattaacctgtat

SEQ ID NO: 6536 - DNA, 27 bp, Artificial Sequence
  Synthetic Oligonucleotide
ccaaatgttttaggatgtatgttactt

SEQ ID NO: 6537 - DNA, 27 bp, Artificial Sequence
  Synthetic Oligonucleotide
ctgagaagactgacatcattgccaatt

SEQ ID NO: 6538 - DNA, 27 bp, Artificial Sequence
  Synthetic Oligonucleotide
taactgttaaaaagaaaacattgaaaa

SEQ ID NO: 6539 - DNA, 27 bp, Artificial Sequence
  Synthetic Oligonucleotide
actattgatgttctgccagaaattgtg

SEQ ID NO: 6540 - DNA, 27 bp, Artificial Sequence
  Synthetic Oligonucleotide
aaaacagtggttcttaaattgtaagct

SEQ ID NO: 6541 - DNA, 27 bp, Artificial Sequence
  Synthetic Oligonucleotide
actttcatcctggaaatatattaactg

SEQ ID NO: 6542 - DNA, 27 bp, Artificial Sequence
  Synthetic Oligonucleotide
aactttggctgataatattgcagcatt

SEQ ID NO: 6543 - DNA, 27 bp, Artificial Sequence
  Synthetic Oligonucleotide
ttatcattttctcctgaggaaaatttt

SEQ ID NO: 6544 - DNA, 27 bp, Artificial Sequence
  Synthetic Oligonucleotide
aaatcagtacttccaaagtctatatat

SEQ ID NO: 6545 - DNA, 27 bp, Artificial Sequence
  Synthetic Oligonucleotide
ccttttatttcattgcttttgactttt

SEQ ID NO: 6546 - DNA, 27 bp, Artificial Sequence
  Synthetic Oligonucleotide
agaaatggactttcatcctggaaatat

SEQ ID NO: 6547 - DNA, 27 bp, Artificial Sequence
  Synthetic Oligonucleotide
tacttccaaagtctatatatgactatt

SEQ ID NO: 6548 - DNA, 27 bp, Artificial Sequence
  Synthetic Oligonucleotide
agggtgtcgttcttttccaacaaaata

SEQ ID NO: 6549 - DNA, 27 bp, Artificial Sequence
  Synthetic Oligonucleotide
taaggtgaaaagataatgatctcattg

SEQ ID NO: 6550 - DNA, 27 bp, Artificial Sequence
  Synthetic Oligonucleotide
tgtattacttgacaaagagacactgtg

SEQ ID NO: 6551 - DNA, 27 bp, Artificial Sequence
  Synthetic Oligonucleotide
atgatgtgcgtaacagattcaaactgc

SEQ ID NO: 6552 - DNA, 27 bp, Artificial Sequence
  Synthetic Oligonucleotide
gatgaaaaattttgaaaccagtacttt

SEQ ID NO: 6553 - DNA, 27 bp, Artificial Sequence
  Synthetic Oligonucleotide
gctgataatattgcagcattttccaga

SEQ ID NO: 6554 - DNA, 27 bp, Artificial Sequence
  Synthetic Oligonucleotide
tctggatgatgtgcgtaacagattcaa

SEQ ID NO: 6555 - DNA, 27 bp, Artificial Sequence
  Synthetic Oligonucleotide
atcgacaagacattggtgaggaaaaat

SEQ ID NO: 6556 - DNA, 27 bp, Artificial Sequence
  Synthetic Oligonucleotide
caaagtgttggtaatgcctgattcaca

SEQ ID NO: 6557 - DNA, 27 bp, Artificial Sequence
  Synthetic Oligonucleotide
caaatggctgagaagactgacatcatt

SEQ ID NO: 6558 - DNA, 27 bp, Artificial Sequence
  Synthetic Oligonucleotide
atgaagaaactttggctgataatattg

SEQ ID NO: 6559 - DNA, 27 bp, Artificial Sequence
  Synthetic Oligonucleotide
tgaaaagataatgatctcattgtttat

SEQ ID NO: 6560 - DNA, 27 bp, Artificial Sequence
  Synthetic Oligonucleotide
tttgtatcaatgattatgaacaacatg

SEQ ID NO: 6561 - DNA, 27 bp, Artificial Sequence
  Synthetic Oligonucleotide
aagactgacatcattgccaattgttgc

SEQ ID NO: 6562 - DNA, 27 bp, Artificial Sequence
  Synthetic Oligonucleotide
gtagcaaacactaaggtgaaaagataa

SEQ ID NO: 6563 - DNA, 27 bp, Artificial Sequence
  Synthetic Oligonucleotide
ggtgccagaatgtgaaagtcatcgaca

SEQ ID NO: 6564 - DNA, 27 bp, Artificial Sequence
  Synthetic Oligonucleotide
agccactattgatgttctgccagaaat

SEQ ID NO: 6565 - DNA, 27 bp, Artificial Sequence
  Synthetic Oligonucleotide
attttgaaaccagtactttatcatttt

SEQ ID NO: 6566 - DNA, 27 bp, Artificial Sequence
  Synthetic Oligonucleotide
tctgtaattccccacttcaatacaaag

SEQ ID NO: 6567 - DNA, 27 bp, Artificial Sequence
  Synthetic Oligonucleotide
gatagcaataacctgtgaaaatgctcc

SEQ ID NO: 6568 - DNA, 27 bp, Artificial Sequence
  Synthetic Oligonucleotide
ttaactgttaaaaagaaaacattgaaa

SEQ ID NO: 6569 - DNA, 27 bp, Artificial Sequence
  Synthetic Oligonucleotide
gccacaactcaggatgaaaaattttga

SEQ ID NO: 6570 - DNA, 27 bp, Artificial Sequence
  Synthetic Oligonucleotide
tcaggttcaaagtgttggtaatgcctg

SEQ ID NO: 6571 - DNA, 27 bp, Artificial Sequence
  Synthetic Oligonucleotide
ttaacctgtattctgtttacatgtctt

SEQ ID NO: 6572 - DNA, 27 bp, Artificial Sequence
  Synthetic Oligonucleotide
caatcacatctttagtgtctgaatata

SEQ ID NO: 6573 - DNA, 27 bp, Artificial Sequence
  Synthetic Oligonucleotide
ttgtaagctcaggttcaaagtgttggt

SEQ ID NO: 6574 - DNA, 27 bp, Artificial Sequence
  Synthetic Oligonucleotide
ttctttgaatgtagatttccaatcaca

SEQ ID NO: 6575 - DNA, 27 bp, Artificial Sequence
  Synthetic Oligonucleotide
ccggaatgttgctgaaacagatctgtc

SEQ ID NO: 6576 - DNA, 27 bp, Artificial Sequence
  Synthetic Oligonucleotide
attaactgttaaaaagaaaacattgaa

SEQ ID NO: 6577 - DNA, 27 bp, Artificial Sequence
  Synthetic Oligonucleotide
aaatatattaactgttaaaaagaaaac

SEQ ID NO: 6578 - DNA, 27 bp, Artificial Sequence
  Synthetic Oligonucleotide
caaatgttttaggatgtatgttacttc

SEQ ID NO: 6579 - DNA, 27 bp, Artificial Sequence
  Synthetic Oligonucleotide
atttgtatcaatgattatgaacaacat

SEQ ID NO: 6580 - DNA, 27 bp, Artificial Sequence
  Synthetic Oligonucleotide
tttaaaacagtggttcttaaattgtaa

SEQ ID NO: 6581 - DNA, 27 bp, Artificial Sequence
  Synthetic Oligonucleotide
gaagaaactttggctgataatattgca

SEQ ID NO: 6582 - DNA, 27 bp, Artificial Sequence
  Synthetic Oligonucleotide
ccaagatctgacagtgcacaatatttt

SEQ ID NO: 6583 - DNA, 27 bp, Artificial Sequence
  Synthetic Oligonucleotide
ctaaggtgaaaagataatgatctcatt

SEQ ID NO: 6584 - DNA, 27 bp, Artificial Sequence
  Synthetic Oligonucleotide
taatattgcagcattttccagatggaa

SEQ ID NO: 6585 - DNA, 27 bp, Artificial Sequence
  Synthetic Oligonucleotide
ggtagcaaacactaaggtgaaaagata

SEQ ID NO: 6586 - DNA, 27 bp, Artificial Sequence
  Synthetic Oligonucleotide
ttggtaatgcctgattcacaactttga

SEQ ID NO: 6587 - DNA, 27 bp, Artificial Sequence
  Synthetic Oligonucleotide
aatgtgaaagtcatcgacaagacattg

SEQ ID NO: 6588 - DNA, 27 bp, Artificial Sequence
  Synthetic Oligonucleotide
ttaaaacagtggttcttaaattgtaag

SEQ ID NO: 6589 - DNA, 27 bp, Artificial Sequence
  Synthetic Oligonucleotide
cctgtattctgtttacatgtctttaaa

SEQ ID NO: 6590 - DNA, 27 bp, Artificial Sequence
  Synthetic Oligonucleotide
tgagaagactgacatcattgccaattg

SEQ ID NO: 6591 - DNA, 27 bp, Artificial Sequence
  Synthetic Oligonucleotide
tcttaaattgtaagctcaggttcaaag

SEQ ID NO: 6592 - DNA, 27 bp, Artificial Sequence
  Synthetic Oligonucleotide
tagcaaacactaaggtgaaaagataat

SEQ ID NO: 6593 - DNA, 27 bp, Artificial Sequence
  Synthetic Oligonucleotide
ctcaggttcaaagtgttggtaatgcct

SEQ ID NO: 6594 - DNA, 27 bp, Artificial Sequence
  Synthetic Oligonucleotide
gacaagacattggtgaggaaaaatcct

SEQ ID NO: 6595 - DNA, 27 bp, Artificial Sequence
  Synthetic Oligonucleotide
aggtagcaaacactaaggtgaaaagat

SEQ ID NO: 6596 - DNA, 27 bp, Artificial Sequence
  Synthetic Oligonucleotide
taaaacagtggttcttaaattgtaagc

SEQ ID NO: 6597 - DNA, 27 bp, Artificial Sequence
  Synthetic Oligonucleotide
gttcaaagtgttggtaatgcctgattc

SEQ ID NO: 6598 - DNA, 27 bp, Artificial Sequence
  Synthetic Oligonucleotide
tattaacctgtattctgtttacatgtc

SEQ ID NO: 6599 - DNA, 27 bp, Artificial Sequence
  Synthetic Oligonucleotide
gtgttggtaatgcctgattcacaactt

SEQ ID NO: 6600 - DNA, 27 bp, Artificial Sequence
  Synthetic Oligonucleotide
tcagtacttccaaagtctatatatgac

SEQ ID NO: 6601 - DNA, 27 bp, Artificial Sequence
  Synthetic Oligonucleotide
cagtacttccaaagtctatatatgact

SEQ ID NO: 6602 - DNA, 27 bp, Artificial Sequence
  Synthetic Oligonucleotide
tcaatgattatgaacaacatgctaaat

SEQ ID NO: 6603 - DNA, 27 bp, Artificial Sequence
  Synthetic Oligonucleotide
tgttcaagatgtcctcgagatactaaa

SEQ ID NO: 6604 - DNA, 27 bp, Artificial Sequence
  Synthetic Oligonucleotide
ctttaaaacagtggttcttaaattgta

SEQ ID NO: 6605 - DNA, 27 bp, Artificial Sequence
  Synthetic Oligonucleotide
gatctcattgtttattaacctgtattc

SEQ ID NO: 6606 - DNA, 27 bp, Artificial Sequence
  Synthetic Oligonucleotide
agtgttggtaatgcctgattcacaact

SEQ ID NO: 6607 - DNA, 27 bp, Artificial Sequence
  Synthetic Oligonucleotide
acaacatgctaaatcagtacttccaaa

SEQ ID NO: 6608 - DNA, 27 bp, Artificial Sequence
  Synthetic Oligonucleotide
ttcttaaattgtaagctcaggttcaaa

SEQ ID NO: 6609 - DNA, 27 bp, Artificial Sequence
  Synthetic Oligonucleotide
ttcgttggctgcaactgtatatctaca

SEQ ID NO: 6610 - DNA, 27 bp, Artificial Sequence
  Synthetic Oligonucleotide
taaatcagtacttccaaagtctatata

SEQ ID NO: 6611 - DNA, 27 bp, Artificial Sequence
  Synthetic Oligonucleotide
acaagacattggtgaggaaaaatcctt

SEQ ID NO: 6612 - DNA, 27 bp, Artificial Sequence
  Synthetic Oligonucleotide
gcatgtattacttgacaaagagacact

SEQ ID NO: 6613 - DNA, 27 bp, Artificial Sequence
  Synthetic Oligonucleotide
gtgatacttctttgaatgtagatttcc

SEQ ID NO: 6614 - DNA, 27 bp, Artificial Sequence
  Synthetic Oligonucleotide
caagatctgacagtgcacaatattttc

SEQ ID NO: 6615 - DNA, 27 bp, Artificial Sequence
  Synthetic Oligonucleotide
acatctttagtgtctgaatatatccaa

SEQ ID NO: 6616 - DNA, 27 bp, Artificial Sequence
  Synthetic Oligonucleotide
agcaaacactaaggtgaaaagataatg

SEQ ID NO: 6617 - DNA, 27 bp, Artificial Sequence
  Synthetic Oligonucleotide
atagcaataacctgtgaaaatgctccc

SEQ ID NO: 6618 - DNA, 27 bp, Artificial Sequence
  Synthetic Oligonucleotide
aatatattaactgttaaaaagaaaaca

SEQ ID NO: 6619 - DNA, 27 bp, Artificial Sequence
  Synthetic Oligonucleotide
tgatgtgcgtaacagattcaaactgcc

SEQ ID NO: 6620 - DNA, 27 bp, Artificial Sequence
  Synthetic Oligonucleotide
aatcagtacttccaaagtctatatatg

SEQ ID NO: 6621 - DNA, 27 bp, Artificial Sequence
  Synthetic Oligonucleotide
ggtaattggtgatacttctttgaatgt

SEQ ID NO: 6622 - DNA, 27 bp, Artificial Sequence
  Synthetic Oligonucleotide
ttccaacaaaatagcaatcccttttat

SEQ ID NO: 6623 - DNA, 27 bp, Artificial Sequence
  Synthetic Oligonucleotide
tgtaagctcaggttcaaagtgttggta

SEQ ID NO: 6624 - DNA, 27 bp, Artificial Sequence
  Synthetic Oligonucleotide
atctgacagtgcacaatattttcccat

SEQ ID NO: 6625 - DNA, 27 bp, Artificial Sequence
  Synthetic Oligonucleotide
ttgcagcattttccagatggaagctgt

SEQ ID NO: 6626 - DNA, 27 bp, Artificial Sequence
  Synthetic Oligonucleotide
gtggttcttaaattgtaagctcaggtt

SEQ ID NO: 6627 - DNA, 27 bp, Artificial Sequence
  Synthetic Oligonucleotide
tgatgaagaaactttggctgataatat

SEQ ID NO: 6628 - DNA, 27 bp, Artificial Sequence
  Synthetic Oligonucleotide
aaacactaaggtgaaaagataatgatc

SEQ ID NO: 6629 - DNA, 27 bp, Artificial Sequence
  Synthetic Oligonucleotide
attgtttattaacctgtattctgttta

SEQ ID NO: 6630 - DNA, 27 bp, Artificial Sequence
  Synthetic Oligonucleotide
cgccacaactcaggatgaaaaattttg

SEQ ID NO: 6631 - DNA, 27 bp, Artificial Sequence
  Synthetic Oligonucleotide
agaaactttggctgataatattgcagc

SEQ ID NO: 6632 - DNA, 27 bp, Artificial Sequence
  Synthetic Oligonucleotide
gtgcacaatattttcccatctgtatta

SEQ ID NO: 6633 - DNA, 27 bp, Artificial Sequence
  Synthetic Oligonucleotide
gtgaaagtcatcgacaagacattggtg

SEQ ID NO: 6634 - DNA, 27 bp, Artificial Sequence
  Synthetic Oligonucleotide
gattatgaacaacatgctaaatcagta

SEQ ID NO: 6635 - DNA, 27 bp, Artificial Sequence
  Synthetic Oligonucleotide
acctgtattctgtttacatgtctttaa

SEQ ID NO: 6636 - DNA, 27 bp, Artificial Sequence
  Synthetic Oligonucleotide
tgataatattgcagcattttccagatg

SEQ ID NO: 6637 - DNA, 27 bp, Artificial Sequence
  Synthetic Oligonucleotide
atattttcccatctgtattattttttt

SEQ ID NO: 6638 - DNA, 27 bp, Artificial Sequence
  Synthetic Oligonucleotide
tgtatgttacttcttagagagaaataa

SEQ ID NO: 6639 - DNA, 27 bp, Artificial Sequence
  Synthetic Oligonucleotide
tcatcgacaagacattggtgaggaaaa

SEQ ID NO: 6640 - DNA, 27 bp, Artificial Sequence
  Synthetic Oligonucleotide
agctcaggttcaaagtgttggtaatgc

SEQ ID NO: 6641 - DNA, 27 bp, Artificial Sequence
  Synthetic Oligonucleotide
atgtattacttgacaaagagacactgt

SEQ ID NO: 6642 - DNA, 27 bp, Artificial Sequence
  Synthetic Oligonucleotide
catgtattacttgacaaagagacactg

SEQ ID NO: 6643 - DNA, 27 bp, Artificial Sequence
  Synthetic Oligonucleotide
ggtgtcgttcttttccaacaaaatagc

SEQ ID NO: 6644 - DNA, 27 bp, Artificial Sequence
  Synthetic Oligonucleotide
ccaaagtctatatatgactattacagg

SEQ ID NO: 6645 - DNA, 27 bp, Artificial Sequence
  Synthetic Oligonucleotide
gaggtagcaaacactaaggtgaaaaga

SEQ ID NO: 6646 - DNA, 27 bp, Artificial Sequence
  Synthetic Oligonucleotide
atatcaaatggctgagaagactgacat

SEQ ID NO: 6647 - DNA, 27 bp, Artificial Sequence
  Synthetic Oligonucleotide
aaaccagtactttatcattttctcctg

SEQ ID NO: 6648 - DNA, 27 bp, Artificial Sequence
  Synthetic Oligonucleotide
ggtaatgcctgattcacaactttgaga

SEQ ID NO: 6649 - DNA, 27 bp, Artificial Sequence
  Synthetic Oligonucleotide
ccactattgatgttctgccagaaattg

SEQ ID NO: 6650 - DNA, 27 bp, Artificial Sequence
  Synthetic Oligonucleotide
gtttattaacctgtattctgtttacat

SEQ ID NO: 6651 - DNA, 27 bp, Artificial Sequence
  Synthetic Oligonucleotide
ctattgatgttctgccagaaattgtgg

SEQ ID NO: 6652 - DNA, 27 bp, Artificial Sequence
  Synthetic Oligonucleotide
caggatgaaaaattttgaaaccagtac

SEQ ID NO: 6653 - DNA, 27 bp, Artificial Sequence
  Synthetic Oligonucleotide
tatcattttctcctgaggaaaattttg

SEQ ID NO: 6654 - DNA, 27 bp, Artificial Sequence
  Synthetic Oligonucleotide
tggtaatgcctgattcacaactttgag

SEQ ID NO: 6655 - DNA, 27 bp, Artificial Sequence
  Synthetic Oligonucleotide
aacctgtattctgtttacatgtcttta

SEQ ID NO: 6656 - DNA, 27 bp, Artificial Sequence
  Synthetic Oligonucleotide
aagtcatcgacaagacattggtgagga

SEQ ID NO: 6657 - DNA, 27 bp, Artificial Sequence
  Synthetic Oligonucleotide
tgaagaaactttggctgataatattgc

SEQ ID NO: 6658 - DNA, 27 bp, Artificial Sequence
  Synthetic Oligonucleotide
acagtggttcttaaattgtaagctcag

SEQ ID NO: 6659 - DNA, 27 bp, Artificial Sequence
  Synthetic Oligonucleotide
aatatatccaaatgttttaggatgtat

SEQ ID NO: 6660 - DNA, 27 bp, Artificial Sequence
  Synthetic Oligonucleotide
caagacattggtgaggaaaaatccttt

SEQ ID NO: 6661 - DNA, 27 bp, Artificial Sequence
  Synthetic Oligonucleotide
tctgacagtgcacaatattttcccatc

SEQ ID NO: 6662 - DNA, 27 bp, Artificial Sequence
  Synthetic Oligonucleotide
gtgccagaatgtgaaagtcatcgacaa

SEQ ID NO: 6663 - DNA, 27 bp, Artificial Sequence
  Synthetic Oligonucleotide
tgaatgtagatttccaatcacatcttt

SEQ ID NO: 6664 - DNA, 27 bp, Artificial Sequence
  Synthetic Oligonucleotide
actgttaaaaagaaaacattgaaaatg

SEQ ID NO: 6665 - DNA, 27 bp, Artificial Sequence
  Synthetic Oligonucleotide
tatgaacaacatgctaaatcagtactt

SEQ ID NO: 6666 - DNA, 27 bp, Artificial Sequence
  Synthetic Oligonucleotide
tgtatcaatgattatgaacaacatgct

SEQ ID NO: 6667 - DNA, 27 bp, Artificial Sequence
  Synthetic Oligonucleotide
gtattctgtttacatgtctttaaaaca

SEQ ID NO: 6668 - DNA, 27 bp, Artificial Sequence
  Synthetic Oligonucleotide
caactcaggatgaaaaattttgaaacc

SEQ ID NO: 6669 - DNA, 27 bp, Artificial Sequence
  Synthetic Oligonucleotide
atatccaaatgttttaggatgtatgtt

SEQ ID NO: 6670 - DNA, 27 bp, Artificial Sequence
  Synthetic Oligonucleotide
ggcggtaattggtgatacttctttgaa

SEQ ID NO: 6671 - DNA, 27 bp, Artificial Sequence
  Synthetic Oligonucleotide
gatgaagaaactttggctgataatatt

SEQ ID NO: 6672 - DNA, 27 bp, Artificial Sequence
  Synthetic Oligonucleotide
tttcattgcttttgacttttcaatggg

SEQ ID NO: 6673 - DNA, 27 bp, Artificial Sequence
  Synthetic Oligonucleotide
agtgtctgaatatatccaaatgtttta

SEQ ID NO: 6674 - DNA, 27 bp, Artificial Sequence
  Synthetic Oligonucleotide
cattgtttattaacctgtattctgttt

SEQ ID NO: 6675 - DNA, 27 bp, Artificial Sequence
  Synthetic Oligonucleotide
atatatccaaatgttttaggatgtatg

SEQ ID NO: 6676 - DNA, 27 bp, Artificial Sequence
  Synthetic Oligonucleotide
gacagtgcacaatattttcccatctgt

SEQ ID NO: 6677 - DNA, 27 bp, Artificial Sequence
  Synthetic Oligonucleotide
taacctgtattctgtttacatgtcttt

SEQ ID NO: 6678 - DNA, 27 bp, Artificial Sequence
  Synthetic Oligonucleotide
taatgcctgattcacaactttgagaag

SEQ ID NO: 6679 - DNA, 27 bp, Artificial Sequence
  Synthetic Oligonucleotide
tattgatgttctgccagaaattgtgga

SEQ ID NO: 6680 - DNA, 27 bp, Artificial Sequence
  Synthetic Oligonucleotide
ttgaatgtagatttccaatcacatctt

SEQ ID NO: 6681 - DNA, 27 bp, Artificial Sequence
  Synthetic Oligonucleotide
cccttttatttcattgcttttgacttt

SEQ ID NO: 6682 - DNA, 27 bp, Artificial Sequence
  Synthetic Oligonucleotide
tgccagaatgtgaaagtcatcgacaag

SEQ ID NO: 6683 - DNA, 27 bp, Artificial Sequence
  Synthetic Oligonucleotide
gaatgtgaaagtcatcgacaagacatt

SEQ ID NO: 6684 - DNA, 27 bp, Artificial Sequence
  Synthetic Oligonucleotide
ggatgatgtgcgtaacagattcaaact

SEQ ID NO: 6685 - DNA, 27 bp, Artificial Sequence
  Synthetic Oligonucleotide
aagctcaggttcaaagtgttggtaatg

SEQ ID NO: 6686 - DNA, 27 bp, Artificial Sequence
  Synthetic Oligonucleotide
tattctgtttacatgtctttaaaacag

SEQ ID NO: 6687 - DNA, 27 bp, Artificial Sequence
  Synthetic Oligonucleotide
cgacaagacattggtgaggaaaaatcc

SEQ ID NO: 6688 - DNA, 27 bp, Artificial Sequence
  Synthetic Oligonucleotide
tagtaaaattggaggtagcaaacacta

SEQ ID NO: 6689 - DNA, 27 bp, Artificial Sequence
  Synthetic Oligonucleotide
agtacttccaaagtctatatatgacta

SEQ ID NO: 6690 - DNA, 27 bp, Artificial Sequence
  Synthetic Oligonucleotide
gaatgtagatttccaatcacatcttta

SEQ ID NO: 6691 - DNA, 27 bp, Artificial Sequence
  Synthetic Oligonucleotide
tccaagatctgacagtgcacaatattt

SEQ ID NO: 6692 - DNA, 27 bp, Artificial Sequence
  Synthetic Oligonucleotide
atacttctttgaatgtagatttccaat

SEQ ID NO: 6693 - DNA, 27 bp, Artificial Sequence
  Synthetic Oligonucleotide
ggctgataatattgcagcattttccag

SEQ ID NO: 6694 - DNA, 27 bp, Artificial Sequence
  Synthetic Oligonucleotide
atgctaaatcagtacttccaaagtcta

SEQ ID NO: 6695 - DNA, 27 bp, Artificial Sequence
  Synthetic Oligonucleotide
tagagagaaataaagcatttttgggaa

SEQ ID NO: 6696 - DNA, 27 bp, Artificial Sequence
  Synthetic Oligonucleotide
gaatatatccaaatgttttaggatgta

SEQ ID NO: 6697 - DNA, 27 bp, Artificial Sequence
  Synthetic Oligonucleotide
ttttatttcattgcttttgacttttca

SEQ ID NO: 6698 - DNA, 27 bp, Artificial Sequence
  Synthetic Oligonucleotide
acagtgcacaatattttcccatctgta

SEQ ID NO: 6699 - DNA, 27 bp, Artificial Sequence
  Synthetic Oligonucleotide
atcacatctttagtgtctgaatatatc

SEQ ID NO: 6700 - DNA, 27 bp, Artificial Sequence
  Synthetic Oligonucleotide
atgtatgttacttcttagagagaaata

SEQ ID NO: 6701 - DNA, 27 bp, Artificial Sequence
  Synthetic Oligonucleotide
ctaggaaccttttagaaagaaatggac

SEQ ID NO: 6702 - DNA, 27 bp, Artificial Sequence
  Synthetic Oligonucleotide
gtgttcaagatgtcctcgagatactaa

SEQ ID NO: 6703 - DNA, 27 bp, Artificial Sequence
  Synthetic Oligonucleotide
cccggctaatttgtatcaatgattatg

SEQ ID NO: 6704 - DNA, 27 bp, Artificial Sequence
  Synthetic Oligonucleotide
aaagggtgtcgttcttttccaacaaaa

SEQ ID NO: 6705 - DNA, 27 bp, Artificial Sequence
  Synthetic Oligonucleotide
aaccttttagaaagaaatggactttca

SEQ ID NO: 6706 - DNA, 27 bp, Artificial Sequence
  Synthetic Oligonucleotide
tcattgcttttgacttttcaatgggtg

SEQ ID NO: 6707 - DNA, 27 bp, Artificial Sequence
  Synthetic Oligonucleotide
atcaaatggctgagaagactgacatca

SEQ ID NO: 6708 - DNA, 27 bp, Artificial Sequence
  Synthetic Oligonucleotide
tcgttcttttccaacaaaatagcaatc

SEQ ID NO: 6709 - DNA, 27 bp, Artificial Sequence
  Synthetic Oligonucleotide
gggtgtcgttcttttccaacaaaatag

SEQ ID NO: 6710 - DNA, 27 bp, Artificial Sequence
  Synthetic Oligonucleotide
tttattaacctgtattctgtttacatg

SEQ ID NO: 6711 - DNA, 27 bp, Artificial Sequence
  Synthetic Oligonucleotide
cttaaattgtaagctcaggttcaaagt

SEQ ID NO: 6712 - DNA, 27 bp, Artificial Sequence
  Synthetic Oligonucleotide
tggctgagaagactgacatcattgcca

SEQ ID NO: 6713 - DNA, 27 bp, Artificial Sequence
  Synthetic Oligonucleotide
tccggaatgttgctgaaacagatctgt

SEQ ID NO: 6714 - DNA, 27 bp, Artificial Sequence
  Synthetic Oligonucleotide
tgaatatatccaaatgttttaggatgt

SEQ ID NO: 6715 - DNA, 27 bp, Artificial Sequence
  Synthetic Oligonucleotide
cacagtctgtaattccccacttcaata

SEQ ID NO: 6716 - DNA, 27 bp, Artificial Sequence
  Synthetic Oligonucleotide
ttggctgcaactgtatatctacaagga

SEQ ID NO: 6717 - DNA, 27 bp, Artificial Sequence
  Synthetic Oligonucleotide
tattaactgttaaaaagaaaacattga

SEQ ID NO: 6718 - DNA, 27 bp, Artificial Sequence
  Synthetic Oligonucleotide
atgatgaagaaactttggctgataata

SEQ ID NO: 6719 - DNA, 27 bp, Artificial Sequence
  Synthetic Oligonucleotide
aacaacatgctaaatcagtacttccaa

SEQ ID NO: 6720 - DNA, 27 bp, Artificial Sequence
  Synthetic Oligonucleotide
attggtgatacttctttgaatgtagat

SEQ ID NO: 6721 - DNA, 27 bp, Artificial Sequence
  Synthetic Oligonucleotide
tgattcacaactttgagaaggtagcac

SEQ ID NO: 6722 - DNA, 27 bp, Artificial Sequence
  Synthetic Oligonucleotide
atttcattgcttttgacttttcaatgg

SEQ ID NO: 6723 - DNA, 27 bp, Artificial Sequence
  Synthetic Oligonucleotide
cattttccagatggaagctgtatccaa

SEQ ID NO: 6724 - DNA, 27 bp, Artificial Sequence
  Synthetic Oligonucleotide
tgtattctgtttacatgtctttaaaac

SEQ ID NO: 6725 - DNA, 27 bp, Artificial Sequence
  Synthetic Oligonucleotide
tacttgacaaagagacactgtgcagag

SEQ ID NO: 6726 - DNA, 27 bp, Artificial Sequence
  Synthetic Oligonucleotide
aggttcaaagtgttggtaatgcctgat

SEQ ID NO: 6727 - DNA, 27 bp, Artificial Sequence
  Synthetic Oligonucleotide
aactgttaaaaagaaaacattgaaaat

SEQ ID NO: 6728 - DNA, 27 bp, Artificial Sequence
  Synthetic Oligonucleotide
caatacaaagggtgtcgttcttttcca

SEQ ID NO: 6729 - DNA, 27 bp, Artificial Sequence
  Synthetic Oligonucleotide
tactttatcattttctcctgaggaaaa

SEQ ID NO: 6730 - DNA, 27 bp, Artificial Sequence
  Synthetic Oligonucleotide
tctttaaaacagtggttcttaaattgt

SEQ ID NO: 6731 - DNA, 27 bp, Artificial Sequence
  Synthetic Oligonucleotide
tccaatcacatctttagtgtctgaata

SEQ ID NO: 6732 - DNA, 27 bp, Artificial Sequence
  Synthetic Oligonucleotide
cttccaaagtctatatatgactattac

SEQ ID NO: 6733 - DNA, 27 bp, Artificial Sequence
  Synthetic Oligonucleotide
tttatcattttctcctgaggaaaattt

SEQ ID NO: 6734 - DNA, 27 bp, Artificial Sequence
  Synthetic Oligonucleotide
tatgttacttcttagagagaaataaag

SEQ ID NO: 6735 - DNA, 27 bp, Artificial Sequence
  Synthetic Oligonucleotide
cagtactttatcattttctcctgagga

SEQ ID NO: 6736 - DNA, 27 bp, Artificial Sequence
  Synthetic Oligonucleotide
gatctgacagtgcacaatattttccca

SEQ ID NO: 6737 - DNA, 27 bp, Artificial Sequence
  Synthetic Oligonucleotide
tcaagatgtcctcgagatactaaagga

SEQ ID NO: 6738 - DNA, 27 bp, Artificial Sequence
  Synthetic Oligonucleotide
ttacttgacaaagagacactgtgcaga

SEQ ID NO: 6739 - DNA, 27 bp, Artificial Sequence
  Synthetic Oligonucleotide
aatgcctgattcacaactttgagaagg

SEQ ID NO: 6740 - DNA, 27 bp, Artificial Sequence
  Synthetic Oligonucleotide
attatgaacaacatgctaaatcagtac

SEQ ID NO: 6741 - DNA, 27 bp, Artificial Sequence
  Synthetic Oligonucleotide
aattgtaagctcaggttcaaagtgttg

SEQ ID NO: 6742 - DNA, 27 bp, Artificial Sequence
  Synthetic Oligonucleotide
aagaaatggactttcatcctggaaata

SEQ ID NO: 6743 - DNA, 27 bp, Artificial Sequence
  Synthetic Oligonucleotide
ctaaagtgctgtatcctttagtaaaat

SEQ ID NO: 6744 - DNA, 27 bp, Artificial Sequence
  Synthetic Oligonucleotide
tgagtgggtgccagaatgtgaaagtca

SEQ ID NO: 6745 - DNA, 27 bp, Artificial Sequence
  Synthetic Oligonucleotide
aggatgtatgttacttcttagagagaa

SEQ ID NO: 6746 - DNA, 27 bp, Artificial Sequence
  Synthetic Oligonucleotide
atgtgaaagtcatcgacaagacattgg

SEQ ID NO: 6747 - DNA, 27 bp, Artificial Sequence
  Synthetic Oligonucleotide
gaagatatcaaatggctgagaagactg

SEQ ID NO: 6748 - DNA, 27 bp, Artificial Sequence
  Synthetic Oligonucleotide
attctgtttacatgtctttaaaacagt

SEQ ID NO: 6749 - DNA, 27 bp, Artificial Sequence
  Synthetic Oligonucleotide
aacactaaggtgaaaagataatgatct

SEQ ID NO: 6750 - DNA, 27 bp, Artificial Sequence
  Synthetic Oligonucleotide
aagtctatatatgactattacaggtct

SEQ ID NO: 6751 - DNA, 27 bp, Artificial Sequence
  Synthetic Oligonucleotide
gtactttatcattttctcctgaggaaa

SEQ ID NO: 6752 - DNA, 27 bp, Artificial Sequence
  Synthetic Oligonucleotide
tgcagcattttccagatggaagctgta

SEQ ID NO: 6753 - DNA, 27 bp, Artificial Sequence
  Synthetic Oligonucleotide
catctttagtgtctgaatatatccaaa

SEQ ID NO: 6754 - DNA, 27 bp, Artificial Sequence
  Synthetic Oligonucleotide
gggtgccagaatgtgaaagtcatcgac

SEQ ID NO: 6755 - DNA, 27 bp, Artificial Sequence
  Synthetic Oligonucleotide
gatgtatgttacttcttagagagaaat

SEQ ID NO: 6756 - DNA, 27 bp, Artificial Sequence
  Synthetic Oligonucleotide
aaatggctgagaagactgacatcattg

SEQ ID NO: 6757 - DNA, 27 bp, Artificial Sequence
  Synthetic Oligonucleotide
cacatctttagtgtctgaatatatcca

SEQ ID NO: 6758 - DNA, 27 bp, Artificial Sequence
  Synthetic Oligonucleotide
aagaaactttggctgataatattgcag

SEQ ID NO: 6759 - DNA, 27 bp, Artificial Sequence
  Synthetic Oligonucleotide
caagatgtcctcgagatactaaaggaa

SEQ ID NO: 6760 - DNA, 27 bp, Artificial Sequence
  Synthetic Oligonucleotide
gtcatcgacaagacattggtgaggaaa

SEQ ID NO: 6761 - DNA, 27 bp, Artificial Sequence
  Synthetic Oligonucleotide
aagatctgacagtgcacaatattttcc

SEQ ID NO: 6762 - DNA, 27 bp, Artificial Sequence
  Synthetic Oligonucleotide
atgcctgattcacaactttgagaaggt

SEQ ID NO: 6763 - DNA, 27 bp, Artificial Sequence
  Synthetic Oligonucleotide
tgctgcatatgtggctaaagcaataga

SEQ ID NO: 6764 - DNA, 27 bp, Artificial Sequence
  Synthetic Oligonucleotide
taggaaccttttagaaagaaatggact

SEQ ID NO: 6765 - DNA, 27 bp, Artificial Sequence
  Synthetic Oligonucleotide
ggttcaaagtgttggtaatgcctgatt

SEQ ID NO: 6766 - DNA, 27 bp, Artificial Sequence
  Synthetic Oligonucleotide
gtgctgtatcctttagtaaaattggag

SEQ ID NO: 6767 - DNA, 27 bp, Artificial Sequence
  Synthetic Oligonucleotide
ccgccacaactcaggatgaaaaatttt

SEQ ID NO: 6768 - DNA, 27 bp, Artificial Sequence
  Synthetic Oligonucleotide
tcacatctttagtgtctgaatatatcc

SEQ ID NO: 6769 - DNA, 27 bp, Artificial Sequence
  Synthetic Oligonucleotide
caggttcaaagtgttggtaatgcctga

SEQ ID NO: 6770 - DNA, 27 bp, Artificial Sequence
  Synthetic Oligonucleotide
tcattttctcctgaggaaaattttgga

SEQ ID NO: 6771 - DNA, 27 bp, Artificial Sequence
  Synthetic Oligonucleotide
tcgttggctgcaactgtatatctacaa

SEQ ID NO: 6772 - DNA, 27 bp, Artificial Sequence
  Synthetic Oligonucleotide
cacttcgttggctgcaactgtatatct

SEQ ID NO: 6773 - DNA, 27 bp, Artificial Sequence
  Synthetic Oligonucleotide
cttttatttcattgcttttgacttttc

SEQ ID NO: 6774 - DNA, 27 bp, Artificial Sequence
  Synthetic Oligonucleotide
aatattttcccatctgtattatttttt

SEQ ID NO: 6775 - DNA, 27 bp, Artificial Sequence
  Synthetic Oligonucleotide
tgacatcattgccaattgttgcaaagg

SEQ ID NO: 6776 - DNA, 27 bp, Artificial Sequence
  Synthetic Oligonucleotide
gagaaataaagcatttttgggaagaat

SEQ ID NO: 6777 - DNA, 27 bp, Artificial Sequence
  Synthetic Oligonucleotide
acagtctgtaattccccacttcaatac

SEQ ID NO: 6778 - DNA, 27 bp, Artificial Sequence
  Synthetic Oligonucleotide
gctgagaagactgacatcattgccaat

SEQ ID NO: 6779 - DNA, 27 bp, Artificial Sequence
  Synthetic Oligonucleotide
ttcttttccaacaaaatagcaatccct

SEQ ID NO: 6780 - DNA, 27 bp, Artificial Sequence
  Synthetic Oligonucleotide
gccactattgatgttctgccagaaatt

SEQ ID NO: 6781 - DNA, 27 bp, Artificial Sequence
  Synthetic Oligonucleotide
gaacaacatgctaaatcagtacttcca

SEQ ID NO: 6782 - DNA, 27 bp, Artificial Sequence
  Synthetic Oligonucleotide
tcctttagtaaaattggaggtagcaaa

SEQ ID NO: 6783 - DNA, 27 bp, Artificial Sequence
  Synthetic Oligonucleotide
tgcttttgacttttcaatgggtgtcct

SEQ ID NO: 6784 - DNA, 27 bp, Artificial Sequence
  Synthetic Oligonucleotide
accttttagaaagaaatggactttcat

SEQ ID NO: 6785 - DNA, 27 bp, Artificial Sequence
  Synthetic Oligonucleotide
ccaatcacatctttagtgtctgaatat

SEQ ID NO: 6786 - DNA, 27 bp, Artificial Sequence
  Synthetic Oligonucleotide
aatattgcagcattttccagatggaag

SEQ ID NO: 6787 - DNA, 27 bp, Artificial Sequence
  Synthetic Oligonucleotide
gttggctgcaactgtatatctacaagg

SEQ ID NO: 6788 - DNA, 27 bp, Artificial Sequence
  Synthetic Oligonucleotide
tattacttgacaaagagacactgtgca

SEQ ID NO: 6789 - DNA, 27 bp, Artificial Sequence
  Synthetic Oligonucleotide
ccatctatcagctgggaagatatcaaa

SEQ ID NO: 6790 - DNA, 27 bp, Artificial Sequence
  Synthetic Oligonucleotide
ctttagtgtctgaatatatccaaatgt

SEQ ID NO: 6791 - DNA, 27 bp, Artificial Sequence
  Synthetic Oligonucleotide
aatcacatctttagtgtctgaatatat

SEQ ID NO: 6792 - DNA, 27 bp, Artificial Sequence
  Synthetic Oligonucleotide
gcaatcccttttatttcattgcttttg

SEQ ID NO: 6793 - DNA, 27 bp, Artificial Sequence
  Synthetic Oligonucleotide
atctttagtgtctgaatatatccaaat

SEQ ID NO: 6794 - DNA, 27 bp, Artificial Sequence
  Synthetic Oligonucleotide
attaacctgtattctgtttacatgtct

SEQ ID NO: 6795 - DNA, 27 bp, Artificial Sequence
  Synthetic Oligonucleotide
gacatcattgccaattgttgcaaaggg

SEQ ID NO: 6796 - DNA, 27 bp, Artificial Sequence
  Synthetic Oligonucleotide
caaagggtgtcgttcttttccaacaaa

SEQ ID NO: 6797 - DNA, 27 bp, Artificial Sequence
  Synthetic Oligonucleotide
tgtcctcgagatactaaaggaagaatt

SEQ ID NO: 6798 - DNA, 27 bp, Artificial Sequence
  Synthetic Oligonucleotide
tgttacttcttagagagaaataaagca

SEQ ID NO: 6799 - DNA, 27 bp, Artificial Sequence
  Synthetic Oligonucleotide
atacaaagggtgtcgttcttttccaac

SEQ ID NO: 6800 - DNA, 27 bp, Artificial Sequence
  Synthetic Oligonucleotide
ttaggatgtatgttacttcttagagag

SEQ ID NO: 6801 - DNA, 27 bp, Artificial Sequence
  Synthetic Oligonucleotide
ttggctgataatattgcagcattttcc

SEQ ID NO: 6802 - DNA, 27 bp, Artificial Sequence
  Synthetic Oligonucleotide
ttccaagatctgacagtgcacaatatt

SEQ ID NO: 6803 - DNA, 27 bp, Artificial Sequence
  Synthetic Oligonucleotide
tcaaatggctgagaagactgacatcat

SEQ ID NO: 6804 - DNA, 27 bp, Artificial Sequence
  Synthetic Oligonucleotide
acttccaaagtctatatatgactatta

SEQ ID NO: 6805 - DNA, 27 bp, Artificial Sequence
  Synthetic Oligonucleotide
ttagagagaaataaagcatttttggga

SEQ ID NO: 6806 - DNA, 27 bp, Artificial Sequence
  Synthetic Oligonucleotide
gttacttcttagagagaaataaagcat

SEQ ID NO: 6807 - DNA, 27 bp, Artificial Sequence
  Synthetic Oligonucleotide
tgggtgccagaatgtgaaagtcatcga

SEQ ID NO: 6808 - DNA, 27 bp, Artificial Sequence
  Synthetic Oligonucleotide
gctcaggttcaaagtgttggtaatgcc

SEQ ID NO: 6809 - DNA, 27 bp, Artificial Sequence
  Synthetic Oligonucleotide
agaaggtagcactggagagaattggaa

SEQ ID NO: 6810 - DNA, 27 bp, Artificial Sequence
  Synthetic Oligonucleotide
acactaaggtgaaaagataatgatctc

SEQ ID NO: 6811 - DNA, 27 bp, Artificial Sequence
  Synthetic Oligonucleotide
ataatattgcagcattttccagatgga

SEQ ID NO: 6812 - DNA, 27 bp, Artificial Sequence
  Synthetic Oligonucleotide
aaagaaatggactttcatcctggaaat

SEQ ID NO: 6813 - DNA, 27 bp, Artificial Sequence
  Synthetic Oligonucleotide
tcttagagagaaataaagcatttttgg

SEQ ID NO: 6814 - DNA, 27 bp, Artificial Sequence
  Synthetic Oligonucleotide
agtggttcttaaattgtaagctcaggt

SEQ ID NO: 6815 - DNA, 27 bp, Artificial Sequence
  Synthetic Oligonucleotide
ctttatcattttctcctgaggaaaatt

SEQ ID NO: 6816 - DNA, 27 bp, Artificial Sequence
  Synthetic Oligonucleotide
gatacttctttgaatgtagatttccaa

SEQ ID NO: 6817 - DNA, 27 bp, Artificial Sequence
  Synthetic Oligonucleotide
gttcttaaattgtaagctcaggttcaa

SEQ ID NO: 6818 - DNA, 27 bp, Artificial Sequence
  Synthetic Oligonucleotide
acatgctaaatcagtacttccaaagtc

SEQ ID NO: 6819 - DNA, 27 bp, Artificial Sequence
  Synthetic Oligonucleotide
ggaatgttgctgaaacagatctgtcga

SEQ ID NO: 6820 - DNA, 27 bp, Artificial Sequence
  Synthetic Oligonucleotide
attgtaagctcaggttcaaagtgttgg

SEQ ID NO: 6821 - DNA, 27 bp, Artificial Sequence
  Synthetic Oligonucleotide
agatctgtcgacttctgttttaggaca

SEQ ID NO: 6822 - DNA, 27 bp, Artificial Sequence
  Synthetic Oligonucleotide
ctacaaggccatatttgtgacagtgga

SEQ ID NO: 6823 - DNA, 27 bp, Artificial Sequence
  Synthetic Oligonucleotide
tacatgtctttaaaacagtggttctta

SEQ ID NO: 6824 - DNA, 27 bp, Artificial Sequence
  Synthetic Oligonucleotide
gtaattccccacttcaatacaaagggt

SEQ ID NO: 6825 - DNA, 27 bp, Artificial Sequence
  Synthetic Oligonucleotide
gtctggatgatgtgcgtaacagattca

SEQ ID NO: 6826 - DNA, 27 bp, Artificial Sequence
  Synthetic Oligonucleotide
tggaggtagcaaacactaaggtgaaaa

SEQ ID NO: 6827 - DNA, 27 bp, Artificial Sequence
  Synthetic Oligonucleotide
ttcttagagagaaataaagcatttttg

SEQ ID NO: 6828 - DNA, 27 bp, Artificial Sequence
  Synthetic Oligonucleotide
atgttttaggatgtatgttacttctta

SEQ ID NO: 6829 - DNA, 27 bp, Artificial Sequence
  Synthetic Oligonucleotide
atgtcctcgagatactaaaggaagaat

SEQ ID NO: 6830 - DNA, 27 bp, Artificial Sequence
  Synthetic Oligonucleotide
gcctgattcacaactttgagaaggtag

SEQ ID NO: 6831 - DNA, 27 bp, Artificial Sequence
  Synthetic Oligonucleotide
ttctgtttacatgtctttaaaacagtg

SEQ ID NO: 6832 - DNA, 27 bp, Artificial Sequence
  Synthetic Oligonucleotide
aagatatcaaatggctgagaagactga

SEQ ID NO: 6833 - DNA, 27 bp, Artificial Sequence
  Synthetic Oligonucleotide
tttggctgataatattgcagcattttc

SEQ ID NO: 6834 - DNA, 27 bp, Artificial Sequence
  Synthetic Oligonucleotide
tccagatggaagctgtatccaaggatg

SEQ ID NO: 6835 - DNA, 27 bp, Artificial Sequence
  Synthetic Oligonucleotide
acttcgttggctgcaactgtatatcta

SEQ ID NO: 6836 - DNA, 27 bp, Artificial Sequence
  Synthetic Oligonucleotide
gaaggtagcactggagagaattggaat

SEQ ID NO: 6837 - DNA, 27 bp, Artificial Sequence
  Synthetic Oligonucleotide
aatgttgctgaaacagatctgtcgact

SEQ ID NO: 6838 - DNA, 27 bp, Artificial Sequence
  Synthetic Oligonucleotide
cgttggctgcaactgtatatctacaag

SEQ ID NO: 6839 - DNA, 27 bp, Artificial Sequence
  Synthetic Oligonucleotide
ttagaaagaaatggactttcatcctgg

SEQ ID NO: 6840 - DNA, 27 bp, Artificial Sequence
  Synthetic Oligonucleotide
agtgcacaatattttcccatctgtatt

SEQ ID NO: 6841 - DNA, 27 bp, Artificial Sequence
  Synthetic Oligonucleotide
cagtgcacaatattttcccatctgtat

SEQ ID NO: 6842 - DNA, 27 bp, Artificial Sequence
  Synthetic Oligonucleotide
gattcacaactttgagaaggtagcact

SEQ ID NO: 6843 - DNA, 27 bp, Artificial Sequence
  Synthetic Oligonucleotide
gatgctccggaatgttgctgaaacaga

SEQ ID NO: 6844 - DNA, 27 bp, Artificial Sequence
  Synthetic Oligonucleotide
cttcaatacaaagggtgtcgttctttt

SEQ ID NO: 6845 - DNA, 27 bp, Artificial Sequence
  Synthetic Oligonucleotide
tgcaactgtatatctacaaggaccgag

SEQ ID NO: 6846 - DNA, 27 bp, Artificial Sequence
  Synthetic Oligonucleotide
tttgaatgtagatttccaatcacatct

SEQ ID NO: 6847 - DNA, 27 bp, Artificial Sequence
  Synthetic Oligonucleotide
ggatgtatgttacttcttagagagaaa

SEQ ID NO: 6848 - DNA, 27 bp, Artificial Sequence
  Synthetic Oligonucleotide
aatgttttaggatgtatgttacttctt

SEQ ID NO: 6849 - DNA, 27 bp, Artificial Sequence
  Synthetic Oligonucleotide
gatgatgtgcgtaacagattcaaactg

SEQ ID NO: 6850 - DNA, 27 bp, Artificial Sequence
  Synthetic Oligonucleotide
ttagtaaaattggaggtagcaaacact

SEQ ID NO: 6851 - DNA, 27 bp, Artificial Sequence
  Synthetic Oligonucleotide
aggtgttcaagatgtcctcgagatact

SEQ ID NO: 6852 - DNA, 27 bp, Artificial Sequence
  Synthetic Oligonucleotide
ttacttcttagagagaaataaagcatt

SEQ ID NO: 6853 - DNA, 27 bp, Artificial Sequence
  Synthetic Oligonucleotide
tgacagtgcacaatattttcccatctg

SEQ ID NO: 6854 - DNA, 27 bp, Artificial Sequence
  Synthetic Oligonucleotide
aaggtgttcaagatgtcctcgagatac

SEQ ID NO: 6855 - DNA, 27 bp, Artificial Sequence
  Synthetic Oligonucleotide
atgttacttcttagagagaaataaagc

SEQ ID NO: 6856 - DNA, 27 bp, Artificial Sequence
  Synthetic Oligonucleotide
aatacaaagggtgtcgttcttttccaa

SEQ ID NO: 6857 - DNA, 27 bp, Artificial Sequence
  Synthetic Oligonucleotide
acatgtctttaaaacagtggttcttaa

SEQ ID NO: 6858 - DNA, 27 bp, Artificial Sequence
  Synthetic Oligonucleotide
gcagagggtgaccacagtctgtaattc

SEQ ID NO: 6859 - DNA, 27 bp, Artificial Sequence
  Synthetic Oligonucleotide
ccaaggatgctccggaatgttgctgaa

SEQ ID NO: 6860 - DNA, 27 bp, Artificial Sequence
  Synthetic Oligonucleotide
agagagaaataaagcatttttgggaag

SEQ ID NO: 6861 - DNA, 27 bp, Artificial Sequence
  Synthetic Oligonucleotide
tctttgaatgtagatttccaatcacat

SEQ ID NO: 6862 - DNA, 27 bp, Artificial Sequence
  Synthetic Oligonucleotide
ctgtttacatgtctttaaaacagtggt

SEQ ID NO: 6863 - DNA, 27 bp, Artificial Sequence
  Synthetic Oligonucleotide
aattggaggtagcaaacactaaggtga

SEQ ID NO: 6864 - DNA, 27 bp, Artificial Sequence
  Synthetic Oligonucleotide
ctaaagcaatagacccatctatcagct

SEQ ID NO: 6865 - DNA, 27 bp, Artificial Sequence
  Synthetic Oligonucleotide
caacatgctaaatcagtacttccaaag

SEQ ID NO: 6866 - DNA, 27 bp, Artificial Sequence
  Synthetic Oligonucleotide
tacttctttgaatgtagatttccaatc

SEQ ID NO: 6867 - DNA, 27 bp, Artificial Sequence
  Synthetic Oligonucleotide
tgccaattgttgcaaagggcattttga

SEQ ID NO: 6868 - DNA, 27 bp, Artificial Sequence
  Synthetic Oligonucleotide
ggctaaagtgctgtatcctttagtaaa

SEQ ID NO: 6869 - DNA, 27 bp, Artificial Sequence
  Synthetic Oligonucleotide
gtattacttgacaaagagacactgtgc

SEQ ID NO: 6870 - DNA, 27 bp, Artificial Sequence
  Synthetic Oligonucleotide
ggttcttaaattgtaagctcaggttca

SEQ ID NO: 6871 - DNA, 27 bp, Artificial Sequence
  Synthetic Oligonucleotide
tgaaacagatctgtcgacttctgtttt

SEQ ID NO: 6872 - DNA, 27 bp, Artificial Sequence
  Synthetic Oligonucleotide
gataatattgcagcattttccagatgg

SEQ ID NO: 6873 - DNA, 27 bp, Artificial Sequence
  Synthetic Oligonucleotide
ctgattcacaactttgagaaggtagca

SEQ ID NO: 6874 - DNA, 27 bp, Artificial Sequence
  Synthetic Oligonucleotide
ctgcatatgtggctaaagcaatagacc

SEQ ID NO: 6875 - DNA, 27 bp, Artificial Sequence
  Synthetic Oligonucleotide
aagggtgtcgttcttttccaacaaaat

SEQ ID NO: 6876 - DNA, 27 bp, Artificial Sequence
  Synthetic Oligonucleotide
aaccgtctggatgatgtgcgtaacaga

SEQ ID NO: 6877 - DNA, 27 bp, Artificial Sequence
  Synthetic Oligonucleotide
cctaggaaccttttagaaagaaatgga

SEQ ID NO: 6878 - DNA, 27 bp, Artificial Sequence
  Synthetic Oligonucleotide
cagccactattgatgttctgccagaaa

SEQ ID NO: 6879 - DNA, 27 bp, Artificial Sequence
  Synthetic Oligonucleotide
ttcaatacaaagggtgtcgttcttttc

SEQ ID NO: 6880 - DNA, 27 bp, Artificial Sequence
  Synthetic Oligonucleotide
cttctttgaatgtagatttccaatcac

SEQ ID NO: 6881 - DNA, 27 bp, Artificial Sequence
  Synthetic Oligonucleotide
cttcgttggctgcaactgtatatctac

SEQ ID NO: 6882 - DNA, 27 bp, Artificial Sequence
  Synthetic Oligonucleotide
tagcaataacctgtgaaaatgctcccc

SEQ ID NO: 6883 - DNA, 27 bp, Artificial Sequence
  Synthetic Oligonucleotide
aaagtctatatatgactattacaggtc

SEQ ID NO: 6884 - DNA, 27 bp, Artificial Sequence
  Synthetic Oligonucleotide
atcattttctcctgaggaaaattttgg

SEQ ID NO: 6885 - DNA, 27 bp, Artificial Sequence
  Synthetic Oligonucleotide
tgcatatgtggctaaagcaatagaccc

SEQ ID NO: 6886 - DNA, 27 bp, Artificial Sequence
  Synthetic Oligonucleotide
gacgacagtggacttgctgcatatgtg

SEQ ID NO: 6887 - DNA, 27 bp, Artificial Sequence
  Synthetic Oligonucleotide
gtttccaagatctgacagtgcacaata

SEQ ID NO: 6888 - DNA, 27 bp, Artificial Sequence
  Synthetic Oligonucleotide
aaatgatgaagaaactttggctgataa

SEQ ID NO: 6889 - DNA, 27 bp, Artificial Sequence
  Synthetic Oligonucleotide
cagagggtgaccacagtctgtaattcc

SEQ ID NO: 6890 - DNA, 27 bp, Artificial Sequence
  Synthetic Oligonucleotide
agagaaataaagcatttttgggaagaa

SEQ ID NO: 6891 - DNA, 27 bp, Artificial Sequence
  Synthetic Oligonucleotide
ttgaatgggatcttggtgtcgaatcat

SEQ ID NO: 6892 - DNA, 27 bp, Artificial Sequence
  Synthetic Oligonucleotide
ctgtaattccccacttcaatacaaagg

SEQ ID NO: 6893 - DNA, 27 bp, Artificial Sequence
  Synthetic Oligonucleotide
tgctgtatcctttagtaaaattggagg

SEQ ID NO: 6894 - DNA, 27 bp, Artificial Sequence
  Synthetic Oligonucleotide
gagaaggtagcactggagagaattgga

SEQ ID NO: 6895 - DNA, 27 bp, Artificial Sequence
  Synthetic Oligonucleotide
ccagccactattgatgttctgccagaa

SEQ ID NO: 6896 - DNA, 27 bp, Artificial Sequence
  Synthetic Oligonucleotide
ctgacagtgcacaatattttcccatct

SEQ ID NO: 6897 - DNA, 27 bp, Artificial Sequence
  Synthetic Oligonucleotide
tgtcctaggaaccttttagaaagaaat

SEQ ID NO: 6898 - DNA, 27 bp, Artificial Sequence
  Synthetic Oligonucleotide
tgaatgggatcttggtgtcgaatcatg

SEQ ID NO: 6899 - DNA, 27 bp, Artificial Sequence
  Synthetic Oligonucleotide
agagggtgaccacagtctgtaattccc

SEQ ID NO: 6900 - DNA, 27 bp, Artificial Sequence
  Synthetic Oligonucleotide
agatctgacagtgcacaatattttccc

SEQ ID NO: 6901 - DNA, 27 bp, Artificial Sequence
  Synthetic Oligonucleotide
gtacttccaaagtctatatatgactat

SEQ ID NO: 6902 - DNA, 27 bp, Artificial Sequence
  Synthetic Oligonucleotide
tttagaaagaaatggactttcatcctg

SEQ ID NO: 6903 - DNA, 27 bp, Artificial Sequence
  Synthetic Oligonucleotide
gagtgggtgccagaatgtgaaagtcat

SEQ ID NO: 6904 - DNA, 27 bp, Artificial Sequence
  Synthetic Oligonucleotide
ctgaggaaaattttggagacgacagtg

SEQ ID NO: 6905 - DNA, 27 bp, Artificial Sequence
  Synthetic Oligonucleotide
tggggtgccagccactattgatgttct

SEQ ID NO: 6906 - DNA, 27 bp, Artificial Sequence
  Synthetic Oligonucleotide
ccccggctaatttgtatcaatgattat

SEQ ID NO: 6907 - DNA, 27 bp, Artificial Sequence
  Synthetic Oligonucleotide
tgcagagggtgaccacagtctgtaatt

SEQ ID NO: 6908 - DNA, 27 bp, Artificial Sequence
  Synthetic Oligonucleotide
acaaggccatatttgtgacagtggaca

SEQ ID NO: 6909 - DNA, 27 bp, Artificial Sequence
  Synthetic Oligonucleotide
gtctttaaaacagtggttcttaaattg

SEQ ID NO: 6910 - DNA, 27 bp, Artificial Sequence
  Synthetic Oligonucleotide
tcctcgagatactaaaggaagaattcc

SEQ ID NO: 6911 - DNA, 27 bp, Artificial Sequence
  Synthetic Oligonucleotide
aaagcaatagacccatctatcagctgg

SEQ ID NO: 6912 - DNA, 27 bp, Artificial Sequence
  Synthetic Oligonucleotide
gcattttccagatggaagctgtatcca

SEQ ID NO: 6913 - DNA, 27 bp, Artificial Sequence
  Synthetic Oligonucleotide
catgctaaatcagtacttccaaagtct

SEQ ID NO: 6914 - DNA, 27 bp, Artificial Sequence
  Synthetic Oligonucleotide
ccttttagaaagaaatggactttcatc

SEQ ID NO: 6915 - DNA, 27 bp, Artificial Sequence
  Synthetic Oligonucleotide
agtactttatcattttctcctgaggaa

SEQ ID NO: 6916 - DNA, 27 bp, Artificial Sequence
  Synthetic Oligonucleotide
ctaaatcagtacttccaaagtctatat

SEQ ID NO: 6917 - DNA, 27 bp, Artificial Sequence
  Synthetic Oligonucleotide
aacagatctgtcgacttctgttttagg

SEQ ID NO: 6918 - DNA, 27 bp, Artificial Sequence
  Synthetic Oligonucleotide
aagacattggtgaggaaaaatcctttg

SEQ ID NO: 6919 - DNA, 27 bp, Artificial Sequence
  Synthetic Oligonucleotide
tttccaacaaaatagcaatccctttta

SEQ ID NO: 6920 - DNA, 27 bp, Artificial Sequence
  Synthetic Oligonucleotide
aaacagatctgtcgacttctgttttag

SEQ ID NO: 6921 - DNA, 27 bp, Artificial Sequence
  Synthetic Oligonucleotide
caactgtatatctacaaggaccgagaa

SEQ ID NO: 6922 - DNA, 27 bp, Artificial Sequence
  Synthetic Oligonucleotide
cctgattcacaactttgagaaggtagc

SEQ ID NO: 6923 - DNA, 27 bp, Artificial Sequence
  Synthetic Oligonucleotide
gaaactttggctgataatattgcagca

SEQ ID NO: 6924 - DNA, 27 bp, Artificial Sequence
  Synthetic Oligonucleotide
ttccaatcacatctttagtgtctgaat

SEQ ID NO: 6925 - DNA, 27 bp, Artificial Sequence
  Synthetic Oligonucleotide
atgctccggaatgttgctgaaacagat

SEQ ID NO: 6926 - DNA, 27 bp, Artificial Sequence
  Synthetic Oligonucleotide
tgtaattccccacttcaatacaaaggg

SEQ ID NO: 6927 - DNA, 27 bp, Artificial Sequence
  Synthetic Oligonucleotide
gaaccttttagaaagaaatggactttc

SEQ ID NO: 6928 - DNA, 27 bp, Artificial Sequence
  Synthetic Oligonucleotide
ggtgttcaagatgtcctcgagatacta

SEQ ID NO: 6929 - DNA, 27 bp, Artificial Sequence
  Synthetic Oligonucleotide
taattccccacttcaatacaaagggtg

SEQ ID NO: 6930 - DNA, 27 bp, Artificial Sequence
  Synthetic Oligonucleotide
tggctgcaactgtatatctacaaggac

SEQ ID NO: 6931 - DNA, 27 bp, Artificial Sequence
  Synthetic Oligonucleotide
atgtctttaaaacagtggttcttaaat

SEQ ID NO: 6932 - DNA, 27 bp, Artificial Sequence
  Synthetic Oligonucleotide
ggacagagggtcagcatgccaatatgt

SEQ ID NO: 6933 - DNA, 27 bp, Artificial Sequence
  Synthetic Oligonucleotide
aagatgtcctcgagatactaaaggaag

SEQ ID NO: 6934 - DNA, 27 bp, Artificial Sequence
  Synthetic Oligonucleotide
tggcggtaattggtgatacttctttga

SEQ ID NO: 6935 - DNA, 27 bp, Artificial Sequence
  Synthetic Oligonucleotide
cttcttagagagaaataaagcattttt

SEQ ID NO: 6936 - DNA, 27 bp, Artificial Sequence
  Synthetic Oligonucleotide
gtaaaattggaggtagcaaacactaag

SEQ ID NO: 6937 - DNA, 27 bp, Artificial Sequence
  Synthetic Oligonucleotide
tgtctttaaaacagtggttcttaaatt

SEQ ID NO: 6938 - DNA, 27 bp, Artificial Sequence
  Synthetic Oligonucleotide
taggatgtatgttacttcttagagaga

SEQ ID NO: 6939 - DNA, 27 bp, Artificial Sequence
  Synthetic Oligonucleotide
ctgtatcctttagtaaaattggaggta

SEQ ID NO: 6940 - DNA, 27 bp, Artificial Sequence
  Synthetic Oligonucleotide
cagcattttccagatggaagctgtatc

SEQ ID NO: 6941 - DNA, 27 bp, Artificial Sequence
  Synthetic Oligonucleotide
tcacaactttgagaaggtagcactgga

SEQ ID NO: 6942 - DNA, 27 bp, Artificial Sequence
  Synthetic Oligonucleotide
gttcttttccaacaaaatagcaatccc

SEQ ID NO: 6943 - DNA, 27 bp, Artificial Sequence
  Synthetic Oligonucleotide
ctgagtgggtgccagaatgtgaaagtc

SEQ ID NO: 6944 - DNA, 27 bp, Artificial Sequence
  Synthetic Oligonucleotide
tatcaaatggctgagaagactgacatc

SEQ ID NO: 6945 - DNA, 27 bp, Artificial Sequence
  Synthetic Oligonucleotide
tgccgccacaactcaggatgaaaaatt

SEQ ID NO: 6946 - DNA, 27 bp, Artificial Sequence
  Synthetic Oligonucleotide
aaggatgctccggaatgttgctgaaac

SEQ ID NO: 6947 - DNA, 27 bp, Artificial Sequence
  Synthetic Oligonucleotide
ggaggtagcaaacactaaggtgaaaag

SEQ ID NO: 6948 - DNA, 27 bp, Artificial Sequence
  Synthetic Oligonucleotide
ccacagtctgtaattccccacttcaat

SEQ ID NO: 6949 - DNA, 27 bp, Artificial Sequence
  Synthetic Oligonucleotide
gaatgttgctgaaacagatctgtcgac

SEQ ID NO: 6950 - DNA, 27 bp, Artificial Sequence
  Synthetic Oligonucleotide
gctaaatcagtacttccaaagtctata

SEQ ID NO: 6951 - DNA, 27 bp, Artificial Sequence
  Synthetic Oligonucleotide
gcaactgtatatctacaaggaccgaga

SEQ ID NO: 6952 - DNA, 27 bp, Artificial Sequence
  Synthetic Oligonucleotide
aacatgctaaatcagtacttccaaagt

SEQ ID NO: 6953 - DNA, 27 bp, Artificial Sequence
  Synthetic Oligonucleotide
agatatcaaatggctgagaagactgac

SEQ ID NO: 6954 - DNA, 27 bp, Artificial Sequence
  Synthetic Oligonucleotide
tacttcttagagagaaataaagcattt

SEQ ID NO: 6955 - DNA, 27 bp, Artificial Sequence
  Synthetic Oligonucleotide
accgtctggatgatgtgcgtaacagat

SEQ ID NO: 6956 - DNA, 27 bp, Artificial Sequence
  Synthetic Oligonucleotide
ttgccaattgttgcaaagggcattttg

SEQ ID NO: 6957 - DNA, 27 bp, Artificial Sequence
  Synthetic Oligonucleotide
tacaaagggtgtcgttcttttccaaca

SEQ ID NO: 6958 - DNA, 27 bp, Artificial Sequence
  Synthetic Oligonucleotide
agtcatcgacaagacattggtgaggaa

SEQ ID NO: 6959 - DNA, 27 bp, Artificial Sequence
  Synthetic Oligonucleotide
actttggctgataatattgcagcattt

SEQ ID NO: 6960 - DNA, 27 bp, Artificial Sequence
  Synthetic Oligonucleotide
gacttgctgcatatgtggctaaagcaa

SEQ ID NO: 6961 - DNA, 27 bp, Artificial Sequence
  Synthetic Oligonucleotide
tcttttccaacaaaatagcaatccctt

SEQ ID NO: 6962 - DNA, 27 bp, Artificial Sequence
  Synthetic Oligonucleotide
cccacttcaatacaaagggtgtcgttc

SEQ ID NO: 6963 - DNA, 27 bp, Artificial Sequence
  Synthetic Oligonucleotide
tatatccaaatgttttaggatgtatgt

SEQ ID NO: 6964 - DNA, 27 bp, Artificial Sequence
  Synthetic Oligonucleotide
catctatcagctgggaagatatcaaat

SEQ ID NO: 6965 - DNA, 27 bp, Artificial Sequence
  Synthetic Oligonucleotide
acgacagtggacttgctgcatatgtgg

SEQ ID NO: 6966 - DNA, 27 bp, Artificial Sequence
  Synthetic Oligonucleotide
gtgtcctaggaaccttttagaaagaaa

SEQ ID NO: 6967 - DNA, 27 bp, Artificial Sequence
  Synthetic Oligonucleotide
gaccacagtctgtaattccccacttca

SEQ ID NO: 6968 - DNA, 27 bp, Artificial Sequence
  Synthetic Oligonucleotide
caaccgtctggatgatgtgcgtaacag

SEQ ID NO: 6969 - DNA, 27 bp, Artificial Sequence
  Synthetic Oligonucleotide
ggctgcaactgtatatctacaaggacc

SEQ ID NO: 6970 - DNA, 27 bp, Artificial Sequence
  Synthetic Oligonucleotide
tccaaggatgctccggaatgttgctga

SEQ ID NO: 6971 - DNA, 27 bp, Artificial Sequence
  Synthetic Oligonucleotide
caaggatgctccggaatgttgctgaaa

SEQ ID NO: 6972 - DNA, 27 bp, Artificial Sequence
  Synthetic Oligonucleotide
atgttgctgaaacagatctgtcgactt

SEQ ID NO: 6973 - DNA, 27 bp, Artificial Sequence
  Synthetic Oligonucleotide
caaagggcattttgagaggtgatgatg

SEQ ID NO: 6974 - DNA, 27 bp, Artificial Sequence
  Synthetic Oligonucleotide
gctaaagcaatagacccatctatcagc

SEQ ID NO: 6975 - DNA, 27 bp, Artificial Sequence
  Synthetic Oligonucleotide
ttcaagatgtcctcgagatactaaagg

SEQ ID NO: 6976 - DNA, 27 bp, Artificial Sequence
  Synthetic Oligonucleotide
gtgaccacagtctgtaattccccactt

SEQ ID NO: 6977 - DNA, 27 bp, Artificial Sequence
  Synthetic Oligonucleotide
gaaagtcatcgacaagacattggtgag

SEQ ID NO: 6978 - DNA, 27 bp, Artificial Sequence
  Synthetic Oligonucleotide
tgggaagatatcaaatggctgagaaga

SEQ ID NO: 6979 - DNA, 27 bp, Artificial Sequence
  Synthetic Oligonucleotide
ctcctgaggaaaattttggagacgaca

SEQ ID NO: 6980 - DNA, 27 bp, Artificial Sequence
  Synthetic Oligonucleotide
ttgatgttctgccagaaattgtggagg

SEQ ID NO: 6981 - DNA, 27 bp, Artificial Sequence
  Synthetic Oligonucleotide
tgccagccactattgatgttctgccag

SEQ ID NO: 6982 - DNA, 27 bp, Artificial Sequence
  Synthetic Oligonucleotide
acaaagggtgtcgttcttttccaacaa

SEQ ID NO: 6983 - DNA, 27 bp, Artificial Sequence
  Synthetic Oligonucleotide
catcgacaagacattggtgaggaaaaa

SEQ ID NO: 6984 - DNA, 27 bp, Artificial Sequence
  Synthetic Oligonucleotide
ggaaaggcactgatgttctgaaagctc

SEQ ID NO: 6985 - DNA, 27 bp, Artificial Sequence
  Synthetic Oligonucleotide
agggtgaccacagtctgtaattcccca

SEQ ID NO: 6986 - DNA, 27 bp, Artificial Sequence
  Synthetic Oligonucleotide
gccgccacaactcaggatgaaaaattt

SEQ ID NO: 6987 - DNA, 27 bp, Artificial Sequence
  Synthetic Oligonucleotide
gtggcggtaattggtgatacttctttg

SEQ ID NO: 6988 - DNA, 27 bp, Artificial Sequence
  Synthetic Oligonucleotide
attgcttttgacttttcaatgggtgtc

SEQ ID NO: 6989 - DNA, 27 bp, Artificial Sequence
  Synthetic Oligonucleotide
caatgggtgtcctaggaaccttttaga

SEQ ID NO: 6990 - DNA, 27 bp, Artificial Sequence
  Synthetic Oligonucleotide
attggaggtagcaaacactaaggtgaa

SEQ ID NO: 6991 - DNA, 27 bp, Artificial Sequence
  Synthetic Oligonucleotide
gctgaaacagatctgtcgacttctgtt

SEQ ID NO: 6992 - DNA, 27 bp, Artificial Sequence
  Synthetic Oligonucleotide
tacaaggccatatttgtgacagtggac

SEQ ID NO: 6993 - DNA, 27 bp, Artificial Sequence
  Synthetic Oligonucleotide
attgcagcattttccagatggaagctg

SEQ ID NO: 6994 - DNA, 27 bp, Artificial Sequence
  Synthetic Oligonucleotide
tgctaaatcagtacttccaaagtctat

SEQ ID NO: 6995 - DNA, 27 bp, Artificial Sequence
  Synthetic Oligonucleotide
cagtggttcttaaattgtaagctcagg

SEQ ID NO: 6996 - DNA, 27 bp, Artificial Sequence
  Synthetic Oligonucleotide
cattgcttttgacttttcaatgggtgt

SEQ ID NO: 6997 - DNA, 27 bp, Artificial Sequence
  Synthetic Oligonucleotide
gagagaaataaagcatttttgggaaga

SEQ ID NO: 6998 - DNA, 27 bp, Artificial Sequence
  Synthetic Oligonucleotide
atgtagatttccaatcacatctttagt

SEQ ID NO: 6999 - DNA, 27 bp, Artificial Sequence
  Synthetic Oligonucleotide
ttccagatggaagctgtatccaaggat

SEQ ID NO: 7000 - DNA, 27 bp, Artificial Sequence
  Synthetic Oligonucleotide
caattgttgcaaagggcattttgagag

SEQ ID NO: 7001 - DNA, 27 bp, Artificial Sequence
  Synthetic Oligonucleotide
atctacaaggaccgagaagtcaccaag

SEQ ID NO: 7002 - DNA, 27 bp, Artificial Sequence
  Synthetic Oligonucleotide
tttgagaaggtagcactggagagaatt

SEQ ID NO: 7003 - DNA, 27 bp, Artificial Sequence
  Synthetic Oligonucleotide
ttggaggtagcaaacactaaggtgaaa

SEQ ID NO: 7004 - DNA, 27 bp, Artificial Sequence
  Synthetic Oligonucleotide
acaaggaccgagaagtcaccaagaagc

SEQ ID NO: 7005 - DNA, 27 bp, Artificial Sequence
  Synthetic Oligonucleotide
ggctacaaggccatatttgtgacagtg

SEQ ID NO: 7006 - DNA, 27 bp, Artificial Sequence
  Synthetic Oligonucleotide
ccagtactttatcattttctcctgagg

SEQ ID NO: 7007 - DNA, 27 bp, Artificial Sequence
  Synthetic Oligonucleotide
tagatttccaatcacatctttagtgtc

SEQ ID NO: 7008 - DNA, 27 bp, Artificial Sequence
  Synthetic Oligonucleotide
tttaggatgtatgttacttcttagaga

SEQ ID NO: 7009 - DNA, 27 bp, Artificial Sequence
  Synthetic Oligonucleotide
actttatcattttctcctgaggaaaat

SEQ ID NO: 7010 - DNA, 27 bp, Artificial Sequence
  Synthetic Oligonucleotide
cgtctggatgatgtgcgtaacagattc

SEQ ID NO: 7011 - DNA, 27 bp, Artificial Sequence
  Synthetic Oligonucleotide
actgtatatctacaaggaccgagaagt

SEQ ID NO: 7012 - DNA, 27 bp, Artificial Sequence
  Synthetic Oligonucleotide
caaatgatgaagaaactttggctgata

SEQ ID NO: 7013 - DNA, 27 bp, Artificial Sequence
  Synthetic Oligonucleotide
cagatctgtcgacttctgttttaggac

SEQ ID NO: 7014 - DNA, 27 bp, Artificial Sequence
  Synthetic Oligonucleotide
aaggtagcactggagagaattggaatg

SEQ ID NO: 7015 - DNA, 27 bp, Artificial Sequence
  Synthetic Oligonucleotide
gaaagaaatggactttcatcctggaaa

SEQ ID NO: 7016 - DNA, 27 bp, Artificial Sequence
  Synthetic Oligonucleotide
gaaaggcactgatgttctgaaagctct

SEQ ID NO: 7017 - DNA, 27 bp, Artificial Sequence
  Synthetic Oligonucleotide
aatggctgagaagactgacatcattgc

SEQ ID NO: 7018 - DNA, 27 bp, Artificial Sequence
  Synthetic Oligonucleotide
gccagccactattgatgttctgccaga

SEQ ID NO: 7019 - DNA, 27 bp, Artificial Sequence
  Synthetic Oligonucleotide
ctgcaactgtatatctacaaggaccga

SEQ ID NO: 7020 - DNA, 27 bp, Artificial Sequence
  Synthetic Oligonucleotide
agaaaggtgttcaagatgtcctcgaga

SEQ ID NO: 7021 - DNA, 27 bp, Artificial Sequence
  Synthetic Oligonucleotide
tgttttaggatgtatgttacttcttag

SEQ ID NO: 7022 - DNA, 27 bp, Artificial Sequence
  Synthetic Oligonucleotide
tgggtgtcctaggaaccttttagaaag

SEQ ID NO: 7023 - DNA, 27 bp, Artificial Sequence
  Synthetic Oligonucleotide
gaaacagatctgtcgacttctgtttta

SEQ ID NO: 7024 - DNA, 27 bp, Artificial Sequence
  Synthetic Oligonucleotide
ggaagatatcaaatggctgagaagact

SEQ ID NO: 7025 - DNA, 27 bp, Artificial Sequence
  Synthetic Oligonucleotide
atattgcagcattttccagatggaagc

SEQ ID NO: 7026 - DNA, 27 bp, Artificial Sequence
  Synthetic Oligonucleotide
tcaatacaaagggtgtcgttcttttcc

SEQ ID NO: 7027 - DNA, 27 bp, Artificial Sequence
  Synthetic Oligonucleotide
tgacttttcaatgggtgtcctaggaac

SEQ ID NO: 7028 - DNA, 27 bp, Artificial Sequence
  Synthetic Oligonucleotide
ttgcttttgacttttcaatgggtgtcc

SEQ ID NO: 7029 - DNA, 27 bp, Artificial Sequence
  Synthetic Oligonucleotide
tgttgctgaaacagatctgtcgacttc

SEQ ID NO: 7030 - DNA, 27 bp, Artificial Sequence
  Synthetic Oligonucleotide
cggaatgttgctgaaacagatctgtcg

SEQ ID NO: 7031 - DNA, 27 bp, Artificial Sequence
  Synthetic Oligonucleotide
aggctaaagtgctgtatcctttagtaa

SEQ ID NO: 7032 - DNA, 27 bp, Artificial Sequence
  Synthetic Oligonucleotide
caggctaaagtgctgtatcctttagta

SEQ ID NO: 7033 - DNA, 27 bp, Artificial Sequence
  Synthetic Oligonucleotide
ttgagaaggtagcactggagagaattg

SEQ ID NO: 7034 - DNA, 27 bp, Artificial Sequence
  Synthetic Oligonucleotide
gtggctaaagcaatagacccatctatc

SEQ ID NO: 7035 - DNA, 27 bp, Artificial Sequence
  Synthetic Oligonucleotide
ccaattgttgcaaagggcattttgaga

SEQ ID NO: 7036 - DNA, 27 bp, Artificial Sequence
  Synthetic Oligonucleotide
tttagtaaaattggaggtagcaaacac

SEQ ID NO: 7037 - DNA, 27 bp, Artificial Sequence
  Synthetic Oligonucleotide
tgtatatctacaaggaccgagaagtca

SEQ ID NO: 7038 - DNA, 27 bp, Artificial Sequence
  Synthetic Oligonucleotide
catatgtggctaaagcaatagacccat

SEQ ID NO: 7039 - DNA, 27 bp, Artificial Sequence
  Synthetic Oligonucleotide
aaattggaggtagcaaacactaaggtg

SEQ ID NO: 7040 - DNA, 27 bp, Artificial Sequence
  Synthetic Oligonucleotide
gtatatctacaaggaccgagaagtcac

SEQ ID NO: 7041 - DNA, 27 bp, Artificial Sequence
  Synthetic Oligonucleotide
cagtggacttgctgcatatgtggctaa

SEQ ID NO: 7042 - DNA, 27 bp, Artificial Sequence
  Synthetic Oligonucleotide
tgtatcctttagtaaaattggaggtag

SEQ ID NO: 7043 - DNA, 27 bp, Artificial Sequence
  Synthetic Oligonucleotide
attacttgacaaagagacactgtgcag

SEQ ID NO: 7044 - DNA, 27 bp, Artificial Sequence
  Synthetic Oligonucleotide
ttgacttttcaatgggtgtcctaggaa

SEQ ID NO: 7045 - DNA, 27 bp, Artificial Sequence
  Synthetic Oligonucleotide
ttttagaaagaaatggactttcatcct

SEQ ID NO: 7046 - DNA, 27 bp, Artificial Sequence
  Synthetic Oligonucleotide
ggatgctccggaatgttgctgaaacag

SEQ ID NO: 7047 - DNA, 27 bp, Artificial Sequence
  Synthetic Oligonucleotide
tagaaagaaatggactttcatcctgga

SEQ ID NO: 7048 - DNA, 27 bp, Artificial Sequence
  Synthetic Oligonucleotide
tgtttacatgtctttaaaacagtggtt

SEQ ID NO: 7049 - DNA, 27 bp, Artificial Sequence
  Synthetic Oligonucleotide
aatgatgaagaaactttggctgataat

SEQ ID NO: 7050 - DNA, 27 bp, Artificial Sequence
  Synthetic Oligonucleotide
agacgacagtggacttgctgcatatgt

SEQ ID NO: 7051 - DNA, 27 bp, Artificial Sequence
  Synthetic Oligonucleotide
acagatctgtcgacttctgttttagga

SEQ ID NO: 7052 - DNA, 27 bp, Artificial Sequence
  Synthetic Oligonucleotide
atatgtggctaaagcaatagacccatc

SEQ ID NO: 7053 - DNA, 27 bp, Artificial Sequence
  Synthetic Oligonucleotide
tgcggaaaggcactgatgttctgaaag

SEQ ID NO: 7054 - DNA, 27 bp, Artificial Sequence
  Synthetic Oligonucleotide
gctgcatatgtggctaaagcaatagac

SEQ ID NO: 7055 - DNA, 27 bp, Artificial Sequence
  Synthetic Oligonucleotide
tggagacgacagtggacttgctgcata

SEQ ID NO: 7056 - DNA, 27 bp, Artificial Sequence
  Synthetic Oligonucleotide
gtgcagagggtgaccacagtctgtaat

SEQ ID NO: 7057 - DNA, 27 bp, Artificial Sequence
  Synthetic Oligonucleotide
tctttagtgtctgaatatatccaaatg

SEQ ID NO: 7058 - DNA, 27 bp, Artificial Sequence
  Synthetic Oligonucleotide
gttcaagatgtcctcgagatactaaag

SEQ ID NO: 7059 - DNA, 27 bp, Artificial Sequence
  Synthetic Oligonucleotide
agtaaaattggaggtagcaaacactaa

SEQ ID NO: 7060 - DNA, 27 bp, Artificial Sequence
  Synthetic Oligonucleotide
attcacaactttgagaaggtagcactg

SEQ ID NO: 7061 - DNA, 27 bp, Artificial Sequence
  Synthetic Oligonucleotide
gatatcaaatggctgagaagactgaca

SEQ ID NO: 7062 - DNA, 27 bp, Artificial Sequence
  Synthetic Oligonucleotide
ggagaaaggtgttcaagatgtcctcga

SEQ ID NO: 7063 - DNA, 27 bp, Artificial Sequence
  Synthetic Oligonucleotide
gtagatttccaatcacatctttagtgt

SEQ ID NO: 7064 - DNA, 27 bp, Artificial Sequence
  Synthetic Oligonucleotide
ctttgaatgtagatttccaatcacatc

SEQ ID NO: 7065 - DNA, 27 bp, Artificial Sequence
  Synthetic Oligonucleotide
tattgcagcattttccagatggaagct

SEQ ID NO: 7066 - DNA, 27 bp, Artificial Sequence
  Synthetic Oligonucleotide
ccccacttcaatacaaagggtgtcgtt

SEQ ID NO: 7067 - DNA, 27 bp, Artificial Sequence
  Synthetic Oligonucleotide
acttctttgaatgtagatttccaatca

SEQ ID NO: 7068 - DNA, 27 bp, Artificial Sequence
  Synthetic Oligonucleotide
acttgctgcatatgtggctaaagcaat

SEQ ID NO: 7069 - DNA, 27 bp, Artificial Sequence
  Synthetic Oligonucleotide
aatgggtgtcctaggaaccttttagaa

SEQ ID NO: 7070 - DNA, 27 bp, Artificial Sequence
  Synthetic Oligonucleotide
ggctaaagcaatagacccatctatcag

SEQ ID NO: 7071 - DNA, 27 bp, Artificial Sequence
  Synthetic Oligonucleotide
tcgagatactaaaggaagaattccggt

SEQ ID NO: 7072 - DNA, 27 bp, Artificial Sequence
  Synthetic Oligonucleotide
tgtgcggaaaggcactgatgttctgaa

SEQ ID NO: 7073 - DNA, 27 bp, Artificial Sequence
  Synthetic Oligonucleotide
ttttaggatgtatgttacttcttagag

SEQ ID NO: 7074 - DNA, 27 bp, Artificial Sequence
  Synthetic Oligonucleotide
gaggaaaattttggagacgacagtgga

SEQ ID NO: 7075 - DNA, 27 bp, Artificial Sequence
  Synthetic Oligonucleotide
cctttagtaaaattggaggtagcaaac

SEQ ID NO: 7076 - DNA, 27 bp, Artificial Sequence
  Synthetic Oligonucleotide
aggacagagggtcagcatgccaatatg

SEQ ID NO: 7077 - DNA, 27 bp, Artificial Sequence
  Synthetic Oligonucleotide
tctgtcgacttctgttttaggacagag

SEQ ID NO: 7078 - DNA, 27 bp, Artificial Sequence
  Synthetic Oligonucleotide
gttttaggatgtatgttacttcttaga

SEQ ID NO: 7079 - DNA, 27 bp, Artificial Sequence
  Synthetic Oligonucleotide
gtagcactggagagaattggaatgggt

SEQ ID NO: 7080 - DNA, 27 bp, Artificial Sequence
  Synthetic Oligonucleotide
aaaattggaggtagcaaacactaaggt

SEQ ID NO: 7081 - DNA, 27 bp, Artificial Sequence
  Synthetic Oligonucleotide
atggctgagaagactgacatcattgcc

SEQ ID NO: 7082 - DNA, 27 bp, Artificial Sequence
  Synthetic Oligonucleotide
tttccaatcacatctttagtgtctgaa

SEQ ID NO: 7083 - DNA, 27 bp, Artificial Sequence
  Synthetic Oligonucleotide
acttcaatacaaagggtgtcgttcttt

SEQ ID NO: 7084 - DNA, 27 bp, Artificial Sequence
  Synthetic Oligonucleotide
ctgtatatctacaaggaccgagaagtc

SEQ ID NO: 7085 - DNA, 27 bp, Artificial Sequence
  Synthetic Oligonucleotide
ggacttgctgcatatgtggctaaagca

SEQ ID NO: 7086 - DNA, 27 bp, Artificial Sequence
  Synthetic Oligonucleotide
aaactttggctgataatattgcagcat

SEQ ID NO: 7087 - DNA, 27 bp, Artificial Sequence
  Synthetic Oligonucleotide
aaattttggagacgacagtggacttgc

SEQ ID NO: 7088 - DNA, 27 bp, Artificial Sequence
  Synthetic Oligonucleotide
atctgtcgacttctgttttaggacaga

SEQ ID NO: 7089 - DNA, 27 bp, Artificial Sequence
  Synthetic Oligonucleotide
gtctggggcaaatgatgaagaaacttt

SEQ ID NO: 7090 - DNA, 27 bp, Artificial Sequence
  Synthetic Oligonucleotide
ttctcctgaggaaaattttggagacga

SEQ ID NO: 7091 - DNA, 27 bp, Artificial Sequence
  Synthetic Oligonucleotide
tgtggctaaagcaatagacccatctat

SEQ ID NO: 7092 - DNA, 27 bp, Artificial Sequence
  Synthetic Oligonucleotide
gacagagggtcagcatgccaatatgtg

SEQ ID NO: 7093 - DNA, 27 bp, Artificial Sequence
  Synthetic Oligonucleotide
cttttgacttttcaatgggtgtcctag

SEQ ID NO: 7094 - DNA, 27 bp, Artificial Sequence
  Synthetic Oligonucleotide
cggaaaggcactgatgttctgaaagct

SEQ ID NO: 7095 - DNA, 27 bp, Artificial Sequence
  Synthetic Oligonucleotide
accacagtctgtaattccccacttcaa

SEQ ID NO: 7096 - DNA, 27 bp, Artificial Sequence
  Synthetic Oligonucleotide
ctttggctgataatattgcagcatttt

SEQ ID NO: 7097 - DNA, 27 bp, Artificial Sequence
  Synthetic Oligonucleotide
aggaaccttttagaaagaaatggactt

SEQ ID NO: 7098 - DNA, 27 bp, Artificial Sequence
  Synthetic Oligonucleotide
gtcctcgagatactaaaggaagaattc

SEQ ID NO: 7099 - DNA, 27 bp, Artificial Sequence
  Synthetic Oligonucleotide
cgagatactaaaggaagaattccggtt

SEQ ID NO: 7100 - DNA, 27 bp, Artificial Sequence
  Synthetic Oligonucleotide
cccatctatcagctgggaagatatcaa

SEQ ID NO: 7101 - DNA, 27 bp, Artificial Sequence
  Synthetic Oligonucleotide
tgctgaaacagatctgtcgacttctgt

SEQ ID NO: 7102 - DNA, 27 bp, Artificial Sequence
  Synthetic Oligonucleotide
ctttagtaaaattggaggtagcaaaca

SEQ ID NO: 7103 - DNA, 27 bp, Artificial Sequence
  Synthetic Oligonucleotide
agagacactgtgcagagggtgaccaca

SEQ ID NO: 7104 - DNA, 27 bp, Artificial Sequence
  Synthetic Oligonucleotide
atcctttagtaaaattggaggtagcaa

SEQ ID NO: 7105 - DNA, 27 bp, Artificial Sequence
  Synthetic Oligonucleotide
gcagcattttccagatggaagctgtat

SEQ ID NO: 7106 - DNA, 27 bp, Artificial Sequence
  Synthetic Oligonucleotide
aactgtatatctacaaggaccgagaag

SEQ ID NO: 7107 - DNA, 27 bp, Artificial Sequence
  Synthetic Oligonucleotide
gcttttgacttttcaatgggtgtccta

SEQ ID NO: 7108 - DNA, 27 bp, Artificial Sequence
  Synthetic Oligonucleotide
gctaaagtgctgtatcctttagtaaaa

SEQ ID NO: 7109 - DNA, 27 bp, Artificial Sequence
  Synthetic Oligonucleotide
gtcctaggaaccttttagaaagaaatg

SEQ ID NO: 7110 - DNA, 27 bp, Artificial Sequence
  Synthetic Oligonucleotide
aaagagacactgtgcagagggtgacca

SEQ ID NO: 7111 - DNA, 27 bp, Artificial Sequence
  Synthetic Oligonucleotide
atgggtgtcctaggaaccttttagaaa

SEQ ID NO: 7112 - DNA, 27 bp, Artificial Sequence
  Synthetic Oligonucleotide
agacccatctatcagctgggaagatat

SEQ ID NO: 7113 - DNA, 27 bp, Artificial Sequence
  Synthetic Oligonucleotide
attttctcctgaggaaaattttggaga

SEQ ID NO: 7114 - DNA, 27 bp, Artificial Sequence
  Synthetic Oligonucleotide
taaagcaatagacccatctatcagctg

SEQ ID NO: 7115 - DNA, 27 bp, Artificial Sequence
  Synthetic Oligonucleotide
atggggtgccagccactattgatgttc

SEQ ID NO: 7116 - DNA, 27 bp, Artificial Sequence
  Synthetic Oligonucleotide
ctgaaacagatctgtcgacttctgttt

SEQ ID NO: 7117 - DNA, 27 bp, Artificial Sequence
  Synthetic Oligonucleotide
tccccacttcaatacaaagggtgtcgt

SEQ ID NO: 7118 - DNA, 27 bp, Artificial Sequence
  Synthetic Oligonucleotide
gtttacatgtctttaaaacagtggttc

SEQ ID NO: 7119 - DNA, 27 bp, Artificial Sequence
  Synthetic Oligonucleotide
tgagaaggtagcactggagagaattgg

SEQ ID NO: 7120 - DNA, 27 bp, Artificial Sequence
  Synthetic Oligonucleotide
ctgtatccaaggatgctccggaatgtt

SEQ ID NO: 7121 - DNA, 27 bp, Artificial Sequence
  Synthetic Oligonucleotide
tgcaaagggcattttgagaggtgatga

SEQ ID NO: 7122 - DNA, 27 bp, Artificial Sequence
  Synthetic Oligonucleotide
tgggtggcggtaattggtgatacttct

SEQ ID NO: 7123 - DNA, 27 bp, Artificial Sequence
  Synthetic Oligonucleotide
gccaattgttgcaaagggcattttgag

SEQ ID NO: 7124 - DNA, 27 bp, Artificial Sequence
  Synthetic Oligonucleotide
aatgtagatttccaatcacatctttag

SEQ ID NO: 7125 - DNA, 27 bp, Artificial Sequence
  Synthetic Oligonucleotide
tgacaaagagacactgtgcagagggtg

SEQ ID NO: 7126 - DNA, 27 bp, Artificial Sequence
  Synthetic Oligonucleotide
ttgctgaaacagatctgtcgacttctg

SEQ ID NO: 7127 - DNA, 27 bp, Artificial Sequence
  Synthetic Oligonucleotide
tcctgaggaaaattttggagacgacag

SEQ ID NO: 7128 - DNA, 27 bp, Artificial Sequence
  Synthetic Oligonucleotide
cttagagagaaataaagcatttttggg

SEQ ID NO: 7129 - DNA, 27 bp, Artificial Sequence
  Synthetic Oligonucleotide
tggctaaagcaatagacccatctatca

SEQ ID NO: 7130 - DNA, 27 bp, Artificial Sequence
  Synthetic Oligonucleotide
tcctaggaaccttttagaaagaaatgg

SEQ ID NO: 7131 - DNA, 27 bp, Artificial Sequence
  Synthetic Oligonucleotide
acatcattgccaattgttgcaaagggc

SEQ ID NO: 7132 - DNA, 27 bp, Artificial Sequence
  Synthetic Oligonucleotide
ccagatggaagctgtatccaaggatgc

SEQ ID NO: 7133 - DNA, 27 bp, Artificial Sequence
  Synthetic Oligonucleotide
ctgtgcagagggtgaccacagtctgta

SEQ ID NO: 7134 - DNA, 27 bp, Artificial Sequence
  Synthetic Oligonucleotide
agatggaagctgtatccaaggatgctc

SEQ ID NO: 7135 - DNA, 27 bp, Artificial Sequence
  Synthetic Oligonucleotide
catcattgccaattgttgcaaagggca

SEQ ID NO: 7136 - DNA, 27 bp, Artificial Sequence
  Synthetic Oligonucleotide
aaagtcatcgacaagacattggtgagg

SEQ ID NO: 7137 - DNA, 27 bp, Artificial Sequence
  Synthetic Oligonucleotide
atgtggctaaagcaatagacccatcta

SEQ ID NO: 7138 - DNA, 27 bp, Artificial Sequence
  Synthetic Oligonucleotide
ccgtctggatgatgtgcgtaacagatt

SEQ ID NO: 7139 - DNA, 27 bp, Artificial Sequence
  Synthetic Oligonucleotide
tgctccggaatgttgctgaaacagatc

SEQ ID NO: 7140 - DNA, 27 bp, Artificial Sequence
  Synthetic Oligonucleotide
ttttccaacaaaatagcaatccctttt

SEQ ID NO: 7141 - DNA, 27 bp, Artificial Sequence
  Synthetic Oligonucleotide
cttttagaaagaaatggactttcatcc

SEQ ID NO: 7142 - DNA, 27 bp, Artificial Sequence
  Synthetic Oligonucleotide
gcggaaaggcactgatgttctgaaagc

SEQ ID NO: 7143 - DNA, 27 bp, Artificial Sequence
  Synthetic Oligonucleotide
gaaaggtgttcaagatgtcctcgagat

SEQ ID NO: 7144 - DNA, 27 bp, Artificial Sequence
  Synthetic Oligonucleotide
gagaaaggtgttcaagatgtcctcgag

SEQ ID NO: 7145 - DNA, 27 bp, Artificial Sequence
  Synthetic Oligonucleotide
attgttgcaaagggcattttgagaggt

SEQ ID NO: 7146 - DNA, 27 bp, Artificial Sequence
  Synthetic Oligonucleotide
cgttcttttccaacaaaatagcaatcc

SEQ ID NO: 7147 - DNA, 27 bp, Artificial Sequence
  Synthetic Oligonucleotide
ccacttcaatacaaagggtgtcgttct

SEQ ID NO: 7148 - DNA, 27 bp, Artificial Sequence
  Synthetic Oligonucleotide
tttccaagatctgacagtgcacaatat

SEQ ID NO: 7149 - DNA, 27 bp, Artificial Sequence
  Synthetic Oligonucleotide
cacttcaatacaaagggtgtcgttctt

SEQ ID NO: 7150 - DNA, 27 bp, Artificial Sequence
  Synthetic Oligonucleotide
actttgagaaggtagcactggagagaa

SEQ ID NO: 7151 - DNA, 27 bp, Artificial Sequence
  Synthetic Oligonucleotide
ctgccgccacaactcaggatgaaaaat

SEQ ID NO: 7152 - DNA, 27 bp, Artificial Sequence
  Synthetic Oligonucleotide
gttgctgaaacagatctgtcgacttct

SEQ ID NO: 7153 - DNA, 27 bp, Artificial Sequence
  Synthetic Oligonucleotide
ggaaccttttagaaagaaatggacttt

SEQ ID NO: 7154 - DNA, 27 bp, Artificial Sequence
  Synthetic Oligonucleotide
catgtctttaaaacagtggttcttaaa

SEQ ID NO: 7155 - DNA, 27 bp, Artificial Sequence
  Synthetic Oligonucleotide
attgatgttctgccagaaattgtggag

SEQ ID NO: 7156 - DNA, 27 bp, Artificial Sequence
  Synthetic Oligonucleotide
ggggtgccagccactattgatgttctg

SEQ ID NO: 7157 - DNA, 27 bp, Artificial Sequence
  Synthetic Oligonucleotide
gagacgacagtggacttgctgcatatg

SEQ ID NO: 7158 - DNA, 27 bp, Artificial Sequence
  Synthetic Oligonucleotide
tgttgcaaagggcattttgagaggtga

SEQ ID NO: 7159 - DNA, 27 bp, Artificial Sequence
  Synthetic Oligonucleotide
aaggaccgagaagtcaccaagaagcta

SEQ ID NO: 7160 - DNA, 27 bp, Artificial Sequence
  Synthetic Oligonucleotide
ctccggaatgttgctgaaacagatctg

SEQ ID NO: 7161 - DNA, 27 bp, Artificial Sequence
  Synthetic Oligonucleotide
caggtctggggcaaatgatgaagaaac

SEQ ID NO: 7162 - DNA, 27 bp, Artificial Sequence
  Synthetic Oligonucleotide
gtgccagccactattgatgttctgcca

SEQ ID NO: 7163 - DNA, 27 bp, Artificial Sequence
  Synthetic Oligonucleotide
gtgcggaaaggcactgatgttctgaaa

SEQ ID NO: 7164 - DNA, 27 bp, Artificial Sequence
  Synthetic Oligonucleotide
cttgctgcatatgtggctaaagcaata

SEQ ID NO: 7165 - DNA, 27 bp, Artificial Sequence
  Synthetic Oligonucleotide
ctgggaagatatcaaatggctgagaag

SEQ ID NO: 7166 - DNA, 27 bp, Artificial Sequence
  Synthetic Oligonucleotide
ggtgtcctaggaaccttttagaaagaa

SEQ ID NO: 7167 - DNA, 27 bp, Artificial Sequence
  Synthetic Oligonucleotide
ctcgagatactaaaggaagaattccgg

SEQ ID NO: 7168 - DNA, 27 bp, Artificial Sequence
  Synthetic Oligonucleotide
tgggctacaaggccatatttgtgacag

SEQ ID NO: 7169 - DNA, 27 bp, Artificial Sequence
  Synthetic Oligonucleotide
ttcacaactttgagaaggtagcactgg

SEQ ID NO: 7170 - DNA, 27 bp, Artificial Sequence
  Synthetic Oligonucleotide
gcacttcgttggctgcaactgtatatc

SEQ ID NO: 7171 - DNA, 27 bp, Artificial Sequence
  Synthetic Oligonucleotide
tgatgttctgccagaaattgtggaggc

SEQ ID NO: 7172 - DNA, 27 bp, Artificial Sequence
  Synthetic Oligonucleotide
tgtagatttccaatcacatctttagtg

SEQ ID NO: 7173 - DNA, 27 bp, Artificial Sequence
  Synthetic Oligonucleotide
tggacttgctgcatatgtggctaaagc

SEQ ID NO: 7174 - DNA, 27 bp, Artificial Sequence
  Synthetic Oligonucleotide
agcattttccagatggaagctgtatcc

SEQ ID NO: 7175 - DNA, 27 bp, Artificial Sequence
  Synthetic Oligonucleotide
agacattggtgaggaaaaatcctttgg

SEQ ID NO: 7176 - DNA, 27 bp, Artificial Sequence
  Synthetic Oligonucleotide
ggtgccagccactattgatgttctgcc

SEQ ID NO: 7177 - DNA, 27 bp, Artificial Sequence
  Synthetic Oligonucleotide
tacaaggaccgagaagtcaccaagaag

SEQ ID NO: 7178 - DNA, 27 bp, Artificial Sequence
  Synthetic Oligonucleotide
caaggccatatttgtgacagtggacac

SEQ ID NO: 7179 - DNA, 27 bp, Artificial Sequence
  Synthetic Oligonucleotide
ggtggcggtaattggtgatacttcttt

SEQ ID NO: 7180 - DNA, 27 bp, Artificial Sequence
  Synthetic Oligonucleotide
tgtatccaaggatgctccggaatgttg

SEQ ID NO: 7181 - DNA, 27 bp, Artificial Sequence
  Synthetic Oligonucleotide
cagatggaagctgtatccaaggatgct

SEQ ID NO: 7182 - DNA, 27 bp, Artificial Sequence
  Synthetic Oligonucleotide
tcaatgggtgtcctaggaaccttttag

SEQ ID NO: 7183 - DNA, 27 bp, Artificial Sequence
  Synthetic Oligonucleotide
acaactttgagaaggtagcactggaga

SEQ ID NO: 7184 - DNA, 27 bp, Artificial Sequence
  Synthetic Oligonucleotide
ttacatgtctttaaaacagtggttctt

SEQ ID NO: 7185 - DNA, 27 bp, Artificial Sequence
  Synthetic Oligonucleotide
aatgggtggcggtaattggtgatactt

SEQ ID NO: 7186 - DNA, 27 bp, Artificial Sequence
  Synthetic Oligonucleotide
ttttcaatgggtgtcctaggaaccttt

SEQ ID NO: 7187 - DNA, 27 bp, Artificial Sequence
  Synthetic Oligonucleotide
cttgacaaagagacactgtgcagaggg

SEQ ID NO: 7188 - DNA, 27 bp, Artificial Sequence
  Synthetic Oligonucleotide
agaaagaaatggactttcatcctggaa

SEQ ID NO: 7189 - DNA, 27 bp, Artificial Sequence
  Synthetic Oligonucleotide
gctgtatcctttagtaaaattggaggt

SEQ ID NO: 7190 - DNA, 27 bp, Artificial Sequence
  Synthetic Oligonucleotide
ctatcagctgggaagatatcaaatggc

SEQ ID NO: 7191 - DNA, 27 bp, Artificial Sequence
  Synthetic Oligonucleotide
gggtgccagccactattgatgttctgc

SEQ ID NO: 7192 - DNA, 27 bp, Artificial Sequence
  Synthetic Oligonucleotide
tacaggtctggggcaaatgatgaagaa

SEQ ID NO: 7193 - DNA, 27 bp, Artificial Sequence
  Synthetic Oligonucleotide
gtgggtgccagaatgtgaaagtcatcg

SEQ ID NO: 7194 - DNA, 27 bp, Artificial Sequence
  Synthetic Oligonucleotide
gatggaagctgtatccaaggatgctcc

SEQ ID NO: 7195 - DNA, 27 bp, Artificial Sequence
  Synthetic Oligonucleotide
tctgagtgggtgccagaatgtgaaagt

SEQ ID NO: 7196 - DNA, 27 bp, Artificial Sequence
  Synthetic Oligonucleotide
attttccagatggaagctgtatccaag

SEQ ID NO: 7197 - DNA, 27 bp, Artificial Sequence
  Synthetic Oligonucleotide
atatctacaaggaccgagaagtcacca

SEQ ID NO: 7198 - DNA, 27 bp, Artificial Sequence
  Synthetic Oligonucleotide
tgaggaaaattttggagacgacagtgg

SEQ ID NO: 7199 - DNA, 27 bp, Artificial Sequence
  Synthetic Oligonucleotide
gagggtgaccacagtctgtaattcccc

SEQ ID NO: 7200 - DNA, 27 bp, Artificial Sequence
  Synthetic Oligonucleotide
ttgacaaagagacactgtgcagagggt

SEQ ID NO: 7201 - DNA, 27 bp, Artificial Sequence
  Synthetic Oligonucleotide
aaaggtgttcaagatgtcctcgagata

SEQ ID NO: 7202 - DNA, 27 bp, Artificial Sequence
  Synthetic Oligonucleotide
tagcactggagagaattggaatgggtg

SEQ ID NO: 7203 - DNA, 27 bp, Artificial Sequence
  Synthetic Oligonucleotide
tttacatgtctttaaaacagtggttct

SEQ ID NO: 7204 - DNA, 27 bp, Artificial Sequence
  Synthetic Oligonucleotide
ccgagaagtcaccaagaagctagtgcg

SEQ ID NO: 7205 - DNA, 27 bp, Artificial Sequence
  Synthetic Oligonucleotide
agtctatatatgactattacaggtctg

SEQ ID NO: 7206 - DNA, 27 bp, Artificial Sequence
  Synthetic Oligonucleotide
gtctatatatgactattacaggtctgg

SEQ ID NO: 7207 - DNA, 27 bp, Artificial Sequence
  Synthetic Oligonucleotide
gcaaagggcattttgagaggtgatgat

SEQ ID NO: 7208 - DNA, 27 bp, Artificial Sequence
  Synthetic Oligonucleotide
gggaagatatcaaatggctgagaagac

SEQ ID NO: 7209 - DNA, 27 bp, Artificial Sequence
  Synthetic Oligonucleotide
acagattcaaactgccgccacaactca

SEQ ID NO: 7210 - DNA, 27 bp, Artificial Sequence
  Synthetic Oligonucleotide
aggatgctccggaatgttgctgaaaca

SEQ ID NO: 7211 - DNA, 27 bp, Artificial Sequence
  Synthetic Oligonucleotide
cctgaggaaaattttggagacgacagt

SEQ ID NO: 7212 - DNA, 27 bp, Artificial Sequence
  Synthetic Oligonucleotide
ctacaaggaccgagaagtcaccaagaa

SEQ ID NO: 7213 - DNA, 27 bp, Artificial Sequence
  Synthetic Oligonucleotide
gcaaatgatgaagaaactttggctgat

SEQ ID NO: 7214 - DNA, 27 bp, Artificial Sequence
  Synthetic Oligonucleotide
aaaggcactgatgttctgaaagctctg

SEQ ID NO: 7215 - DNA, 27 bp, Artificial Sequence
  Synthetic Oligonucleotide
ggcaaatgatgaagaaactttggctga

SEQ ID NO: 7216 - DNA, 27 bp, Artificial Sequence
  Synthetic Oligonucleotide
atgggtggcggtaattggtgatacttc

SEQ ID NO: 7217 - DNA, 27 bp, Artificial Sequence
  Synthetic Oligonucleotide
tctggggcaaatgatgaagaaactttg

SEQ ID NO: 7218 - DNA, 27 bp, Artificial Sequence
  Synthetic Oligonucleotide
gaatgggtggcggtaattggtgatact

SEQ ID NO: 7219 - DNA, 27 bp, Artificial Sequence
  Synthetic Oligonucleotide
ctgtcgacttctgttttaggacagagg

SEQ ID NO: 7220 - DNA, 27 bp, Artificial Sequence
  Synthetic Oligonucleotide
gctgcaactgtatatctacaaggaccg

SEQ ID NO: 7221 - DNA, 27 bp, Artificial Sequence
  Synthetic Oligonucleotide
gcatatgtggctaaagcaatagaccca

SEQ ID NO: 7222 - DNA, 27 bp, Artificial Sequence
  Synthetic Oligonucleotide
aactgccgccacaactcaggatgaaaa

SEQ ID NO: 7223 - DNA, 27 bp, Artificial Sequence
  Synthetic Oligonucleotide
tctatcagctgggaagatatcaaatgg

SEQ ID NO: 7224 - DNA, 27 bp, Artificial Sequence
  Synthetic Oligonucleotide
taaaattggaggtagcaaacactaagg

SEQ ID NO: 7225 - DNA, 27 bp, Artificial Sequence
  Synthetic Oligonucleotide
gacattggtgaggaaaaatcctttggc

SEQ ID NO: 7226 - DNA, 27 bp, Artificial Sequence
  Synthetic Oligonucleotide
acaaagagacactgtgcagagggtgac

SEQ ID NO: 7227 - DNA, 27 bp, Artificial Sequence
  Synthetic Oligonucleotide
tgaccacagtctgtaattccccacttc

SEQ ID NO: 7228 - DNA, 27 bp, Artificial Sequence
  Synthetic Oligonucleotide
gggagaaaggtgttcaagatgtcctcg

SEQ ID NO: 7229 - DNA, 27 bp, Artificial Sequence
  Synthetic Oligonucleotide
ctttgagaaggtagcactggagagaat

SEQ ID NO: 7230 - DNA, 27 bp, Artificial Sequence
  Synthetic Oligonucleotide
aaagggcattttgagaggtgatgatgc

SEQ ID NO: 7231 - DNA, 27 bp, Artificial Sequence
  Synthetic Oligonucleotide
ttacaggtctggggcaaatgatgaaga

SEQ ID NO: 7232 - DNA, 27 bp, Artificial Sequence
  Synthetic Oligonucleotide
cattttctcctgaggaaaattttggag

SEQ ID NO: 7233 - DNA, 27 bp, Artificial Sequence
  Synthetic Oligonucleotide
gtatcctttagtaaaattggaggtagc

SEQ ID NO: 7234 - DNA, 27 bp, Artificial Sequence
  Synthetic Oligonucleotide
atctatcagctgggaagatatcaaatg

SEQ ID NO: 7235 - DNA, 27 bp, Artificial Sequence
  Synthetic Oligonucleotide
ctgggccacctcctcaattgaagaagt

SEQ ID NO: 7236 - DNA, 27 bp, Artificial Sequence
  Synthetic Oligonucleotide
tctacaaggaccgagaagtcaccaaga

SEQ ID NO: 7237 - DNA, 27 bp, Artificial Sequence
  Synthetic Oligonucleotide
ggaatgggtggcggtaattggtgatac

SEQ ID NO: 7238 - DNA, 27 bp, Artificial Sequence
  Synthetic Oligonucleotide
gggctacaaggccatatttgtgacagt

SEQ ID NO: 7239 - DNA, 27 bp, Artificial Sequence
  Synthetic Oligonucleotide
ttttctcctgaggaaaattttggagac

SEQ ID NO: 7240 - DNA, 27 bp, Artificial Sequence
  Synthetic Oligonucleotide
aggaccgagaagtcaccaagaagctag

SEQ ID NO: 7241 - DNA, 27 bp, Artificial Sequence
  Synthetic Oligonucleotide
gggtgtcctaggaaccttttagaaaga

SEQ ID NO: 7242 - DNA, 27 bp, Artificial Sequence
  Synthetic Oligonucleotide
accgagaagtcaccaagaagctagtgc

SEQ ID NO: 7243 - DNA, 27 bp, Artificial Sequence
  Synthetic Oligonucleotide
cctcgagatactaaaggaagaattccg

SEQ ID NO: 7244 - DNA, 27 bp, Artificial Sequence
  Synthetic Oligonucleotide
ggagacgacagtggacttgctgcatat

SEQ ID NO: 7245 - DNA, 27 bp, Artificial Sequence
  Synthetic Oligonucleotide
tagacccatctatcagctgggaagata

SEQ ID NO: 7246 - DNA, 27 bp, Artificial Sequence
  Synthetic Oligonucleotide
ctctgagtgggtgccagaatgtgaaag

SEQ ID NO: 7247 - DNA, 27 bp, Artificial Sequence
  Synthetic Oligonucleotide
gacaaagagacactgtgcagagggtga

SEQ ID NO: 7248 - DNA, 27 bp, Artificial Sequence
  Synthetic Oligonucleotide
ttgctgcatatgtggctaaagcaatag

SEQ ID NO: 7249 - DNA, 27 bp, Artificial Sequence
  Synthetic Oligonucleotide
acttcttagagagaaataaagcatttt

SEQ ID NO: 7250 - DNA, 27 bp, Artificial Sequence
  Synthetic Oligonucleotide
ttcaatgggtgtcctaggaacctttta

SEQ ID NO: 7251 - DNA, 27 bp, Artificial Sequence
  Synthetic Oligonucleotide
acccatctatcagctgggaagatatca

SEQ ID NO: 7252 - DNA, 27 bp, Artificial Sequence
  Synthetic Oligonucleotide
tctatatatgactattacaggtctggg

SEQ ID NO: 7253 - DNA, 27 bp, Artificial Sequence
  Synthetic Oligonucleotide
acaggtctggggcaaatgatgaagaaa

SEQ ID NO: 7254 - DNA, 27 bp, Artificial Sequence
  Synthetic Oligonucleotide
caatagacccatctatcagctgggaag

SEQ ID NO: 7255 - DNA, 27 bp, Artificial Sequence
  Synthetic Oligonucleotide
attgccaattgttgcaaagggcatttt

SEQ ID NO: 7256 - DNA, 27 bp, Artificial Sequence
  Synthetic Oligonucleotide
agatgtcctcgagatactaaaggaaga

SEQ ID NO: 7257 - DNA, 27 bp, Artificial Sequence
  Synthetic Oligonucleotide
ttgttgcaaagggcattttgagaggtg

SEQ ID NO: 7258 - DNA, 27 bp, Artificial Sequence
  Synthetic Oligonucleotide
gtgtgcggaaaggcactgatgttctga

SEQ ID NO: 7259 - DNA, 27 bp, Artificial Sequence
  Synthetic Oligonucleotide
gctccggaatgttgctgaaacagatct

SEQ ID NO: 7260 - DNA, 27 bp, Artificial Sequence
  Synthetic Oligonucleotide
aggtagcactggagagaattggaatgg

SEQ ID NO: 7261 - DNA, 27 bp, Artificial Sequence
  Synthetic Oligonucleotide
cgacagtggacttgctgcatatgtggc

SEQ ID NO: 7262 - DNA, 27 bp, Artificial Sequence
  Synthetic Oligonucleotide
acagtggacttgctgcatatgtggcta

SEQ ID NO: 7263 - DNA, 27 bp, Artificial Sequence
  Synthetic Oligonucleotide
tgaggcacttcgttggctgcaactgta

SEQ ID NO: 7264 - DNA, 27 bp, Artificial Sequence
  Synthetic Oligonucleotide
atttccaatcacatctttagtgtctga

SEQ ID NO: 7265 - DNA, 27 bp, Artificial Sequence
  Synthetic Oligonucleotide
aattttggagacgacagtggacttgct

SEQ ID NO: 7266 - DNA, 27 bp, Artificial Sequence
  Synthetic Oligonucleotide
tatcctttagtaaaattggaggtagca

SEQ ID NO: 7267 - DNA, 27 bp, Artificial Sequence
  Synthetic Oligonucleotide
cttgaatgggatcttggtgtcgaatca

SEQ ID NO: 7268 - DNA, 27 bp, Artificial Sequence
  Synthetic Oligonucleotide
gcactgatgttctgaaagctctggctc

SEQ ID NO: 7269 - DNA, 27 bp, Artificial Sequence
  Synthetic Oligonucleotide
agcttgccactgtgagagcctgtcagt

SEQ ID NO: 7270 - DNA, 27 bp, Artificial Sequence
  Synthetic Oligonucleotide
ggaaaattttggagacgacagtggact

SEQ ID NO: 7271 - DNA, 27 bp, Artificial Sequence
  Synthetic Oligonucleotide
gggtgaccacagtctgtaattccccac

SEQ ID NO: 7272 - DNA, 27 bp, Artificial Sequence
  Synthetic Oligonucleotide
taggacagagggtcagcatgccaatat

SEQ ID NO: 7273 - DNA, 27 bp, Artificial Sequence
  Synthetic Oligonucleotide
gggtggcggtaattggtgatacttctt

SEQ ID NO: 7274 - DNA, 27 bp, Artificial Sequence
  Synthetic Oligonucleotide
gggcattttgagaggtgatgatgccag

SEQ ID NO: 7275 - DNA, 27 bp, Artificial Sequence
  Synthetic Oligonucleotide
atggaagctgtatccaaggatgctccg

SEQ ID NO: 7276 - DNA, 27 bp, Artificial Sequence
  Synthetic Oligonucleotide
ggtagcactggagagaattggaatggg

SEQ ID NO: 7277 - DNA, 27 bp, Artificial Sequence
  Synthetic Oligonucleotide
ggaccgagaagtcaccaagaagctagt

SEQ ID NO: 7278 - DNA, 27 bp, Artificial Sequence
  Synthetic Oligonucleotide
gacccatctatcagctgggaagatatc

SEQ ID NO: 7279 - DNA, 27 bp, Artificial Sequence
  Synthetic Oligonucleotide
agggaggctgttaaacatggcttgaat

SEQ ID NO: 7280 - DNA, 27 bp, Artificial Sequence
  Synthetic Oligonucleotide
caaggaccgagaagtcaccaagaagct

SEQ ID NO: 7281 - DNA, 27 bp, Artificial Sequence
  Synthetic Oligonucleotide
gctgggaagatatcaaatggctgagaa

SEQ ID NO: 7282 - DNA, 27 bp, Artificial Sequence
  Synthetic Oligonucleotide
tatcagctgggaagatatcaaatggct

SEQ ID NO: 7283 - DNA, 27 bp, Artificial Sequence
  Synthetic Oligonucleotide
gttaaacatggcttgaatgggatcttg

SEQ ID NO: 7284 - DNA, 27 bp, Artificial Sequence
  Synthetic Oligonucleotide
aggaaaattttggagacgacagtggac

SEQ ID NO: 7285 - DNA, 27 bp, Artificial Sequence
  Synthetic Oligonucleotide
ggggagaaaggtgttcaagatgtcctc

SEQ ID NO: 7286 - DNA, 27 bp, Artificial Sequence
  Synthetic Oligonucleotide
gttgcaaagggcattttgagaggtgat

SEQ ID NO: 7287 - DNA, 27 bp, Artificial Sequence
  Synthetic Oligonucleotide
aattgttgcaaagggcattttgagagg

SEQ ID NO: 7288 - DNA, 27 bp, Artificial Sequence
  Synthetic Oligonucleotide
cttttccaacaaaatagcaatcccttt

SEQ ID NO: 7289 - DNA, 27 bp, Artificial Sequence
  Synthetic Oligonucleotide
aattccccacttcaatacaaagggtgt

SEQ ID NO: 7290 - DNA, 27 bp, Artificial Sequence
  Synthetic Oligonucleotide
tgactattacaggtctggggcaaatga

SEQ ID NO: 7291 - DNA, 27 bp, Artificial Sequence
  Synthetic Oligonucleotide
agaaattgtggaggctgtggaagggaa

SEQ ID NO: 7292 - DNA, 27 bp, Artificial Sequence
  Synthetic Oligonucleotide
tgtgcagagggtgaccacagtctgtaa

SEQ ID NO: 7293 - DNA, 27 bp, Artificial Sequence
  Synthetic Oligonucleotide
atcattgccaattgttgcaaagggcat

SEQ ID NO: 7294 - DNA, 27 bp, Artificial Sequence
  Synthetic Oligonucleotide
gtatccaaggatgctccggaatgttgc

SEQ ID NO: 7295 - DNA, 27 bp, Artificial Sequence
  Synthetic Oligonucleotide
gagatactaaaggaagaattccggttg

SEQ ID NO: 7296 - DNA, 27 bp, Artificial Sequence
  Synthetic Oligonucleotide
aagagacactgtgcagagggtgaccac

SEQ ID NO: 7297 - DNA, 27 bp, Artificial Sequence
  Synthetic Oligonucleotide
gaaaattttggagacgacagtggactt

SEQ ID NO: 7298 - DNA, 27 bp, Artificial Sequence
  Synthetic Oligonucleotide
gatctgtcgacttctgttttaggacag

SEQ ID NO: 7299 - DNA, 27 bp, Artificial Sequence
  Synthetic Oligonucleotide
ggtgaccacagtctgtaattccccact

SEQ ID NO: 7300 - DNA, 27 bp, Artificial Sequence
  Synthetic Oligonucleotide
cactgtgcagagggtgaccacagtctg

SEQ ID NO: 7301 - DNA, 27 bp, Artificial Sequence
  Synthetic Oligonucleotide
tttcaatgggtgtcctaggaacctttt

SEQ ID NO: 7302 - DNA, 27 bp, Artificial Sequence
  Synthetic Oligonucleotide
cttttcaatgggtgtcctaggaacctt

SEQ ID NO: 7303 - DNA, 27 bp, Artificial Sequence
  Synthetic Oligonucleotide
gggtgtgcggaaaggcactgatgttct

SEQ ID NO: 7304 - DNA, 27 bp, Artificial Sequence
  Synthetic Oligonucleotide
tatgtggctaaagcaatagacccatct

SEQ ID NO: 7305 - DNA, 27 bp, Artificial Sequence
  Synthetic Oligonucleotide
tcgacttctgttttaggacagagggtc

SEQ ID NO: 7306 - DNA, 27 bp, Artificial Sequence
  Synthetic Oligonucleotide
agatttccaatcacatctttagtgtct

SEQ ID NO: 7307 - DNA, 27 bp, Artificial Sequence
  Synthetic Oligonucleotide
gatgtcctcgagatactaaaggaagaa

SEQ ID NO: 7308 - DNA, 27 bp, Artificial Sequence
  Synthetic Oligonucleotide
ttgcaaagggcattttgagaggtgatg

SEQ ID NO: 7309 - DNA, 27 bp, Artificial Sequence
  Synthetic Oligonucleotide
agatactaaaggaagaattccggttgg

SEQ ID NO: 7310 - DNA, 27 bp, Artificial Sequence
  Synthetic Oligonucleotide
ggcttgaatgggatcttggtgtcgaat

SEQ ID NO: 7311 - DNA, 27 bp, Artificial Sequence
  Synthetic Oligonucleotide
tctgttttaggacagagggtcagcatg

SEQ ID NO: 7312 - DNA, 27 bp, Artificial Sequence
  Synthetic Oligonucleotide
ctgggaacgggcatgatgttgagttcc

SEQ ID NO: 7313 - DNA, 27 bp, Artificial Sequence
  Synthetic Oligonucleotide
tatctacaaggaccgagaagtcaccaa

SEQ ID NO: 7314 - DNA, 27 bp, Artificial Sequence
  Synthetic Oligonucleotide
tctcctgaggaaaattttggagacgac

SEQ ID NO: 7315 - DNA, 27 bp, Artificial Sequence
  Synthetic Oligonucleotide
aggctgttaaacatggcttgaatggga

SEQ ID NO: 7316 - DNA, 27 bp, Artificial Sequence
  Synthetic Oligonucleotide
cgatggggtgccagccactattgatgt

SEQ ID NO: 7317 - DNA, 27 bp, Artificial Sequence
  Synthetic Oligonucleotide
agatgggctacaaggccatatttgtga

SEQ ID NO: 7318 - DNA, 27 bp, Artificial Sequence
  Synthetic Oligonucleotide
ggctgttaaacatggcttgaatgggat

SEQ ID NO: 7319 - DNA, 27 bp, Artificial Sequence
  Synthetic Oligonucleotide
agggcattttgagaggtgatgatgcca

SEQ ID NO: 7320 - DNA, 27 bp, Artificial Sequence
  Synthetic Oligonucleotide
aaaattttggagacgacagtggacttg

SEQ ID NO: 7321 - DNA, 27 bp, Artificial Sequence
  Synthetic Oligonucleotide
agtgggtgccagaatgtgaaagtcatc

SEQ ID NO: 7322 - DNA, 27 bp, Artificial Sequence
  Synthetic Oligonucleotide
gcaaccgtctggatgatgtgcgtaaca

SEQ ID NO: 7323 - DNA, 27 bp, Artificial Sequence
  Synthetic Oligonucleotide
aagcaatagacccatctatcagctggg

SEQ ID NO: 7324 - DNA, 27 bp, Artificial Sequence
  Synthetic Oligonucleotide
agtggacttgctgcatatgtggctaaa

SEQ ID NO: 7325 - DNA, 27 bp, Artificial Sequence
  Synthetic Oligonucleotide
tcattgccaattgttgcaaagggcatt

SEQ ID NO: 7326 - DNA, 27 bp, Artificial Sequence
  Synthetic Oligonucleotide
gactattacaggtctggggcaaatgat

SEQ ID NO: 7327 - DNA, 27 bp, Artificial Sequence
  Synthetic Oligonucleotide
atccaaggatgctccggaatgttgctg

SEQ ID NO: 7328 - DNA, 27 bp, Artificial Sequence
  Synthetic Oligonucleotide
tgccagaaattgtggaggctgtggaag

SEQ ID NO: 7329 - DNA, 27 bp, Artificial Sequence
  Synthetic Oligonucleotide
gctacaaggccatatttgtgacagtgg

SEQ ID NO: 7330 - DNA, 27 bp, Artificial Sequence
  Synthetic Oligonucleotide
tggaatgggtggcggtaattggtgata

SEQ ID NO: 7331 - DNA, 27 bp, Artificial Sequence
  Synthetic Oligonucleotide
ctcgatggggtgccagccactattgat

SEQ ID NO: 7332 - DNA, 27 bp, Artificial Sequence
  Synthetic Oligonucleotide
ttaaacatggcttgaatgggatcttgg

SEQ ID NO: 7333 - DNA, 27 bp, Artificial Sequence
  Synthetic Oligonucleotide
ttccccacttcaatacaaagggtgtcg

SEQ ID NO: 7334 - DNA, 27 bp, Artificial Sequence
  Synthetic Oligonucleotide
tctgtttacatgtctttaaaacagtgg

SEQ ID NO: 7335 - DNA, 27 bp, Artificial Sequence
  Synthetic Oligonucleotide
cactgatgttctgaaagctctggctct

SEQ ID NO: 7336 - DNA, 27 bp, Artificial Sequence
  Synthetic Oligonucleotide
gctctgagtgggtgccagaatgtgaaa

SEQ ID NO: 7337 - DNA, 27 bp, Artificial Sequence
  Synthetic Oligonucleotide
acttgacaaagagacactgtgcagagg

SEQ ID NO: 7338 - DNA, 27 bp, Artificial Sequence
  Synthetic Oligonucleotide
tgtcgacttctgttttaggacagaggg

SEQ ID NO: 7339 - DNA, 27 bp, Artificial Sequence
  Synthetic Oligonucleotide
ttggagacgacagtggacttgctgcat

SEQ ID NO: 7340 - DNA, 27 bp, Artificial Sequence
  Synthetic Oligonucleotide
aagggcattttgagaggtgatgatgcc

SEQ ID NO: 7341 - DNA, 27 bp, Artificial Sequence
  Synthetic Oligonucleotide
cacaactttgagaaggtagcactggag

SEQ ID NO: 7342 - DNA, 27 bp, Artificial Sequence
  Synthetic Oligonucleotide
atgggctacaaggccatatttgtgaca

SEQ ID NO: 7343 - DNA, 27 bp, Artificial Sequence
  Synthetic Oligonucleotide
tgggccacctcctcaattgaagaagtg

SEQ ID NO: 7344 - DNA, 27 bp, Artificial Sequence
  Synthetic Oligonucleotide
ccgtttccaagatctgacagtgcacaa

SEQ ID NO: 7345 - DNA, 27 bp, Artificial Sequence
  Synthetic Oligonucleotide
ggggcaaatgatgaagaaactttggct

SEQ ID NO: 7346 - DNA, 27 bp, Artificial Sequence
  Synthetic Oligonucleotide
gaatgggatcttggtgtcgaatcatgg

SEQ ID NO: 7347 - DNA, 27 bp, Artificial Sequence
  Synthetic Oligonucleotide
tgcgtaacagattcaaactgccgccac

SEQ ID NO: 7348 - DNA, 27 bp, Artificial Sequence
  Synthetic Oligonucleotide
gatgggctacaaggccatatttgtgac

SEQ ID NO: 7349 - DNA, 27 bp, Artificial Sequence
  Synthetic Oligonucleotide
tgggaacgggcatgatgttgagttcct

SEQ ID NO: 7350 - DNA, 27 bp, Artificial Sequence
  Synthetic Oligonucleotide
ttctgttttaggacagagggtcagcat

SEQ ID NO: 7351 - DNA, 27 bp, Artificial Sequence
  Synthetic Oligonucleotide
aaactgccgccacaactcaggatgaaa

SEQ ID NO: 7352 - DNA, 27 bp, Artificial Sequence
  Synthetic Oligonucleotide
gagaagatgggctacaaggccatattt

SEQ ID NO: 7353 - DNA, 27 bp, Artificial Sequence
  Synthetic Oligonucleotide
taacagattcaaactgccgccacaact

SEQ ID NO: 7354 - DNA, 27 bp, Artificial Sequence
  Synthetic Oligonucleotide
tatccaaggatgctccggaatgttgct

SEQ ID NO: 7355 - DNA, 27 bp, Artificial Sequence
  Synthetic Oligonucleotide
tttccagatggaagctgtatccaagga

SEQ ID NO: 7356 - DNA, 27 bp, Artificial Sequence
  Synthetic Oligonucleotide
gaagctgtatccaaggatgctccggaa

SEQ ID NO: 7357 - DNA, 27 bp, Artificial Sequence
  Synthetic Oligonucleotide
tcgatggggtgccagccactattgatg

SEQ ID NO: 7358 - DNA, 27 bp, Artificial Sequence
  Synthetic Oligonucleotide
ttttggagacgacagtggacttgctgc

SEQ ID NO: 7359 - DNA, 27 bp, Artificial Sequence
  Synthetic Oligonucleotide
tgttaaacatggcttgaatgggatctt

SEQ ID NO: 7360 - DNA, 27 bp, Artificial Sequence
  Synthetic Oligonucleotide
aggcacttcgttggctgcaactgtata

SEQ ID NO: 7361 - DNA, 27 bp, Artificial Sequence
  Synthetic Oligonucleotide
atggcttgaatgggatcttggtgtcga

SEQ ID NO: 7362 - DNA, 27 bp, Artificial Sequence
  Synthetic Oligonucleotide
tcagctgggaagatatcaaatggctga

SEQ ID NO: 7363 - DNA, 27 bp, Artificial Sequence
  Synthetic Oligonucleotide
ttttccagatggaagctgtatccaagg

SEQ ID NO: 7364 - DNA, 27 bp, Artificial Sequence
  Synthetic Oligonucleotide
agcaatagacccatctatcagctggga

SEQ ID NO: 7365 - DNA, 27 bp, Artificial Sequence
  Synthetic Oligonucleotide
cgtttccaagatctgacagtgcacaat

SEQ ID NO: 7366 - DNA, 27 bp, Artificial Sequence
  Synthetic Oligonucleotide
caactttgagaaggtagcactggagag

SEQ ID NO: 7367 - DNA, 27 bp, Artificial Sequence
  Synthetic Oligonucleotide
ttgccactgtgagagcctgtcagtccc

SEQ ID NO: 7368 - DNA, 27 bp, Artificial Sequence
  Synthetic Oligonucleotide
aacatggcttgaatgggatcttggtgt

SEQ ID NO: 7369 - DNA, 27 bp, Artificial Sequence
  Synthetic Oligonucleotide
agctgggaagatatcaaatggctgaga

SEQ ID NO: 7370 - DNA, 27 bp, Artificial Sequence
  Synthetic Oligonucleotide
gcttgaatgggatcttggtgtcgaatc

SEQ ID NO: 7371 - DNA, 27 bp, Artificial Sequence
  Synthetic Oligonucleotide
gcaatagacccatctatcagctgggaa

SEQ ID NO: 7372 - DNA, 27 bp, Artificial Sequence
  Synthetic Oligonucleotide
ttttgacttttcaatgggtgtcctagg

SEQ ID NO: 7373 - DNA, 27 bp, Artificial Sequence
  Synthetic Oligonucleotide
tactaaaggaagaattccggttggcca

SEQ ID NO: 7374 - DNA, 27 bp, Artificial Sequence
  Synthetic Oligonucleotide
actgccgccacaactcaggatgaaaaa

SEQ ID NO: 7375 - DNA, 27 bp, Artificial Sequence
  Synthetic Oligonucleotide
gatgtgcgtaacagattcaaactgccg

SEQ ID NO: 7376 - DNA, 27 bp, Artificial Sequence
  Synthetic Oligonucleotide
gggcaaatgatgaagaaactttggctg

SEQ ID NO: 7377 - DNA, 27 bp, Artificial Sequence
  Synthetic Oligonucleotide
ggaacgggcatgatgttgagttcctgg

SEQ ID NO: 7378 - DNA, 27 bp, Artificial Sequence
  Synthetic Oligonucleotide
tggcttgaatgggatcttggtgtcgaa

SEQ ID NO: 7379 - DNA, 27 bp, Artificial Sequence
  Synthetic Oligonucleotide
acattggtgaggaaaaatcctttggcc

SEQ ID NO: 7380 - DNA, 27 bp, Artificial Sequence
  Synthetic Oligonucleotide
gtcgaatcatggggctcgacaactcga

SEQ ID NO: 7381 - DNA, 27 bp, Artificial Sequence
  Synthetic Oligonucleotide
gaagatgggctacaaggccatatttgt

SEQ ID NO: 7382 - DNA, 27 bp, Artificial Sequence
  Synthetic Oligonucleotide
atgtgcgtaacagattcaaactgccgc

SEQ ID NO: 7383 - DNA, 27 bp, Artificial Sequence
  Synthetic Oligonucleotide
aactttgagaaggtagcactggagaga

SEQ ID NO: 7384 - DNA, 27 bp, Artificial Sequence
  Synthetic Oligonucleotide
ctattacaggtctggggcaaatgatga

SEQ ID NO: 7385 - DNA, 27 bp, Artificial Sequence
  Synthetic Oligonucleotide
tttgacttttcaatgggtgtcctagga

SEQ ID NO: 7386 - DNA, 27 bp, Artificial Sequence
  Synthetic Oligonucleotide
gacactgtgcagagggtgaccacagtc

SEQ ID NO: 7387 - DNA, 27 bp, Artificial Sequence
  Synthetic Oligonucleotide
cagaaattgtggaggctgtggaaggga

SEQ ID NO: 7388 - DNA, 27 bp, Artificial Sequence
  Synthetic Oligonucleotide
cattgccaattgttgcaaagggcattt

SEQ ID NO: 7389 - DNA, 27 bp, Artificial Sequence
  Synthetic Oligonucleotide
ggctgtggaagggaaggtggaagtctt

SEQ ID NO: 7390 - DNA, 27 bp, Artificial Sequence
  Synthetic Oligonucleotide
gagcttgccactgtgagagcctgtcag

SEQ ID NO: 7391 - DNA, 27 bp, Artificial Sequence
  Synthetic Oligonucleotide
ctgttttaggacagagggtcagcatgc

SEQ ID NO: 7392 - DNA, 27 bp, Artificial Sequence
  Synthetic Oligonucleotide
tggaagggaaggtggaagtcttcctgg

SEQ ID NO: 7393 - DNA, 27 bp, Artificial Sequence
  Synthetic Oligonucleotide
tggggcaaatgatgaagaaactttggc

SEQ ID NO: 7394 - DNA, 27 bp, Artificial Sequence
  Synthetic Oligonucleotide
caaactgccgccacaactcaggatgaa

SEQ ID NO: 7395 - DNA, 27 bp, Artificial Sequence
  Synthetic Oligonucleotide
ggaagctgtatccaaggatgctccgga

SEQ ID NO: 7396 - DNA, 27 bp, Artificial Sequence
  Synthetic Oligonucleotide
ttttaggacagagggtcagcatgccaa

SEQ ID NO: 7397 - DNA, 27 bp, Artificial Sequence
  Synthetic Oligonucleotide
gtggacttgctgcatatgtggctaaag

SEQ ID NO: 7398 - DNA, 27 bp, Artificial Sequence
  Synthetic Oligonucleotide
ggctctgagtgggtgccagaatgtgaa

SEQ ID NO: 7399 - DNA, 27 bp, Artificial Sequence
  Synthetic Oligonucleotide
ctatatatgactattacaggtctgggg

SEQ ID NO: 7400 - DNA, 27 bp, Artificial Sequence
  Synthetic Oligonucleotide
cgtaacagattcaaactgccgccacaa

SEQ ID NO: 7401 - DNA, 27 bp, Artificial Sequence
  Synthetic Oligonucleotide
gatttccaatcacatctttagtgtctg

SEQ ID NO: 7402 - DNA, 27 bp, Artificial Sequence
  Synthetic Oligonucleotide
caaagagacactgtgcagagggtgacc

SEQ ID NO: 7403 - DNA, 27 bp, Artificial Sequence
  Synthetic Oligonucleotide
ctgtggaagggaaggtggaagtcttcc

SEQ ID NO: 7404 - DNA, 27 bp, Artificial Sequence
  Synthetic Oligonucleotide
gaccgagaagtcaccaagaagctagtg

SEQ ID NO: 7405 - DNA, 27 bp, Artificial Sequence
  Synthetic Oligonucleotide
tgggcaaccgtctggatgatgtgcgta

SEQ ID NO: 7406 - DNA, 27 bp, Artificial Sequence
  Synthetic Oligonucleotide
tggcaggctaaagtgctgtatccttta

SEQ ID NO: 7407 - DNA, 27 bp, Artificial Sequence
  Synthetic Oligonucleotide
gggaggctgttaaacatggcttgaatg

SEQ ID NO: 7408 - DNA, 27 bp, Artificial Sequence
  Synthetic Oligonucleotide
agagaattggaatgggtggcggtaatt

SEQ ID NO: 7409 - DNA, 27 bp, Artificial Sequence
  Synthetic Oligonucleotide
gacttttcaatgggtgtcctaggaacc

SEQ ID NO: 7410 - DNA, 27 bp, Artificial Sequence
  Synthetic Oligonucleotide
atgatgccagggaggctgttaaacatg

SEQ ID NO: 7411 - DNA, 27 bp, Artificial Sequence
  Synthetic Oligonucleotide
cagattcaaactgccgccacaactcag

SEQ ID NO: 7412 - DNA, 27 bp, Artificial Sequence
  Synthetic Oligonucleotide
ttaggacagagggtcagcatgccaata

SEQ ID NO: 7413 - DNA, 27 bp, Artificial Sequence
  Synthetic Oligonucleotide
gagacactgtgcagagggtgaccacag

SEQ ID NO: 7414 - DNA, 27 bp, Artificial Sequence
  Synthetic Oligonucleotide
ttggtgtcgaatcatggggctcgacaa

SEQ ID NO: 7415 - DNA, 27 bp, Artificial Sequence
  Synthetic Oligonucleotide
aatagacccatctatcagctgggaaga

SEQ ID NO: 7416 - DNA, 27 bp, Artificial Sequence
  Synthetic Oligonucleotide
acatggcttgaatgggatcttggtgtc

SEQ ID NO: 7417 - DNA, 27 bp, Artificial Sequence
  Synthetic Oligonucleotide
ttcaaactgccgccacaactcaggatg

SEQ ID NO: 7418 - DNA, 27 bp, Artificial Sequence
  Synthetic Oligonucleotide
tgatgatgccagggaggctgttaaaca

SEQ ID NO: 7419 - DNA, 27 bp, Artificial Sequence
  Synthetic Oligonucleotide
tcctgggccacctcctcaattgaagaa

SEQ ID NO: 7420 - DNA, 27 bp, Artificial Sequence
  Synthetic Oligonucleotide
tgatgttctgaaagctctggctcttgg

SEQ ID NO: 7421 - DNA, 27 bp, Artificial Sequence
  Synthetic Oligonucleotide
actattacaggtctggggcaaatgatg

SEQ ID NO: 7422 - DNA, 27 bp, Artificial Sequence
  Synthetic Oligonucleotide
gatggggtgccagccactattgatgtt

SEQ ID NO: 7423 - DNA, 27 bp, Artificial Sequence
  Synthetic Oligonucleotide
gtcgacttctgttttaggacagagggt

SEQ ID NO: 7424 - DNA, 27 bp, Artificial Sequence
  Synthetic Oligonucleotide
agacactgtgcagagggtgaccacagt

SEQ ID NO: 7425 - DNA, 27 bp, Artificial Sequence
  Synthetic Oligonucleotide
tttaggacagagggtcagcatgccaat

SEQ ID NO: 7426 - DNA, 27 bp, Artificial Sequence
  Synthetic Oligonucleotide
gtggaagggaaggtggaagtcttcctg

SEQ ID NO: 7427 - DNA, 27 bp, Artificial Sequence
  Synthetic Oligonucleotide
aaggcactgatgttctgaaagctctgg

SEQ ID NO: 7428 - DNA, 27 bp, Artificial Sequence
  Synthetic Oligonucleotide
attacaggtctggggcaaatgatgaag

SEQ ID NO: 7429 - DNA, 27 bp, Artificial Sequence
  Synthetic Oligonucleotide
gagaattggaatgggtggcggtaattg

SEQ ID NO: 7430 - DNA, 27 bp, Artificial Sequence
  Synthetic Oligonucleotide
tatatctacaaggaccgagaagtcacc

SEQ ID NO: 7431 - DNA, 27 bp, Artificial Sequence
  Synthetic Oligonucleotide
aacagattcaaactgccgccacaactc

SEQ ID NO: 7432 - DNA, 27 bp, Artificial Sequence
  Synthetic Oligonucleotide
aggtctggggcaaatgatgaagaaact

SEQ ID NO: 7433 - DNA, 27 bp, Artificial Sequence
  Synthetic Oligonucleotide
gggcaaccgtctggatgatgtgcgtaa

SEQ ID NO: 7434 - DNA, 27 bp, Artificial Sequence
  Synthetic Oligonucleotide
tattacaggtctggggcaaatgatgaa

SEQ ID NO: 7435 - DNA, 27 bp, Artificial Sequence
  Synthetic Oligonucleotide
ctggggcaaatgatgaagaaactttgg

SEQ ID NO: 7436 - DNA, 27 bp, Artificial Sequence
  Synthetic Oligonucleotide
agaagatgggctacaaggccatatttg

SEQ ID NO: 7437 - DNA, 27 bp, Artificial Sequence
  Synthetic Oligonucleotide
tttggagacgacagtggacttgctgca

SEQ ID NO: 7438 - DNA, 27 bp, Artificial Sequence
  Synthetic Oligonucleotide
cattttgagaggtgatgatgccaggga

SEQ ID NO: 7439 - DNA, 27 bp, Artificial Sequence
  Synthetic Oligonucleotide
cgagaagtcaccaagaagctagtgcgg

SEQ ID NO: 7440 - DNA, 27 bp, Artificial Sequence
  Synthetic Oligonucleotide
gggaacgggcatgatgttgagttcctg

SEQ ID NO: 7441 - DNA, 27 bp, Artificial Sequence
  Synthetic Oligonucleotide
gaattggaatgggtggcggtaattggt

SEQ ID NO: 7442 - DNA, 27 bp, Artificial Sequence
  Synthetic Oligonucleotide
atgttctgccagaaattgtggaggctg

SEQ ID NO: 7443 - DNA, 27 bp, Artificial Sequence
  Synthetic Oligonucleotide
aggctgtggaagggaaggtggaagtct

SEQ ID NO: 7444 - DNA, 27 bp, Artificial Sequence
  Synthetic Oligonucleotide
gagaccaatcgtttggggcttagcttt

SEQ ID NO: 7445 - DNA, 27 bp, Artificial Sequence
  Synthetic Oligonucleotide
tcaaactgccgccacaactcaggatga

SEQ ID NO: 7446 - DNA, 27 bp, Artificial Sequence
  Synthetic Oligonucleotide
ggtctggggcaaatgatgaagaaactt

SEQ ID NO: 7447 - DNA, 27 bp, Artificial Sequence
  Synthetic Oligonucleotide
ctcaattgaagaagtggcggaagctgg

SEQ ID NO: 7448 - DNA, 27 bp, Artificial Sequence
  Synthetic Oligonucleotide
gcaggctaaagtgctgtatcctttagt

SEQ ID NO: 7449 - DNA, 27 bp, Artificial Sequence
  Synthetic Oligonucleotide
cagctgggaagatatcaaatggctgag

SEQ ID NO: 7450 - DNA, 27 bp, Artificial Sequence
  Synthetic Oligonucleotide
aagctgtatccaaggatgctccggaat

SEQ ID NO: 7451 - DNA, 27 bp, Artificial Sequence
  Synthetic Oligonucleotide
cgagcttgccactgtgagagcctgtca

SEQ ID NO: 7452 - DNA, 27 bp, Artificial Sequence
  Synthetic Oligonucleotide
ccctgggaacgggcatgatgttgagtt

SEQ ID NO: 7453 - DNA, 27 bp, Artificial Sequence
  Synthetic Oligonucleotide
ttggaatgggtggcggtaattggtgat

SEQ ID NO: 7454 - DNA, 27 bp, Artificial Sequence
  Synthetic Oligonucleotide
aggtgatgatgccagggaggctgttaa

SEQ ID NO: 7455 - DNA, 27 bp, Artificial Sequence
  Synthetic Oligonucleotide
gtgtttagacaacgtcatcccctggca

SEQ ID NO: 7456 - DNA, 27 bp, Artificial Sequence
  Synthetic Oligonucleotide
attttggagacgacagtggacttgctg

SEQ ID NO: 7457 - DNA, 27 bp, Artificial Sequence
  Synthetic Oligonucleotide
ggcattttgagaggtgatgatgccagg

SEQ ID NO: 7458 - DNA, 27 bp, Artificial Sequence
  Synthetic Oligonucleotide
aagatgggctacaaggccatatttgtg

SEQ ID NO: 7459 - DNA, 27 bp, Artificial Sequence
  Synthetic Oligonucleotide
gatactaaaggaagaattccggttggc

SEQ ID NO: 7460 - DNA, 27 bp, Artificial Sequence
  Synthetic Oligonucleotide
attttgagaggtgatgatgccagggag

SEQ ID NO: 7461 - DNA, 27 bp, Artificial Sequence
  Synthetic Oligonucleotide
aggcactgatgttctgaaagctctggc

SEQ ID NO: 7462 - DNA, 27 bp, Artificial Sequence
  Synthetic Oligonucleotide
cagggaggctgttaaacatggcttgaa

SEQ ID NO: 7463 - DNA, 27 bp, Artificial Sequence
  Synthetic Oligonucleotide
cttctgttttaggacagagggtcagca

SEQ ID NO: 7464 - DNA, 27 bp, Artificial Sequence
  Synthetic Oligonucleotide
gtaacagattcaaactgccgccacaac

SEQ ID NO: 7465 - DNA, 27 bp, Artificial Sequence
  Synthetic Oligonucleotide
ctgccagaaattgtggaggctgtggaa

SEQ ID NO: 7466 - DNA, 27 bp, Artificial Sequence
  Synthetic Oligonucleotide
ggcaaccgtctggatgatgtgcgtaac

SEQ ID NO: 7467 - DNA, 27 bp, Artificial Sequence
  Synthetic Oligonucleotide
agagaagatgggctacaaggccatatt

SEQ ID NO: 7468 - DNA, 27 bp, Artificial Sequence
  Synthetic Oligonucleotide
atagacccatctatcagctgggaagat

SEQ ID NO: 7469 - DNA, 27 bp, Artificial Sequence
  Synthetic Oligonucleotide
tggctctgagtgggtgccagaatgtga

SEQ ID NO: 7470 - DNA, 27 bp, Artificial Sequence
  Synthetic Oligonucleotide
gccgtttccaagatctgacagtgcaca

SEQ ID NO: 7471 - DNA, 27 bp, Artificial Sequence
  Synthetic Oligonucleotide
ggggtgtgcggaaaggcactgatgttc

SEQ ID NO: 7472 - DNA, 27 bp, Artificial Sequence
  Synthetic Oligonucleotide
tcaattgaagaagtggcggaagctggt

SEQ ID NO: 7473 - DNA, 27 bp, Artificial Sequence
  Synthetic Oligonucleotide
cctgggccacctcctcaattgaagaag

SEQ ID NO: 7474 - DNA, 27 bp, Artificial Sequence
  Synthetic Oligonucleotide
acctcctcaattgaagaagtggcggaa

SEQ ID NO: 7475 - DNA, 27 bp, Artificial Sequence
  Synthetic Oligonucleotide
ctgttaaacatggcttgaatgggatct

SEQ ID NO: 7476 - DNA, 27 bp, Artificial Sequence
  Synthetic Oligonucleotide
tggccgtttccaagatctgacagtgca

SEQ ID NO: 7477 - DNA, 27 bp, Artificial Sequence
  Synthetic Oligonucleotide
tcctcaattgaagaagtggcggaagct

SEQ ID NO: 7478 - DNA, 27 bp, Artificial Sequence
  Synthetic Oligonucleotide
tatatatgactattacaggtctggggc

SEQ ID NO: 7479 - DNA, 27 bp, Artificial Sequence
  Synthetic Oligonucleotide
ggcacttcgttggctgcaactgtatat

SEQ ID NO: 7480 - DNA, 27 bp, Artificial Sequence
  Synthetic Oligonucleotide
ttcctgggccacctcctcaattgaaga

SEQ ID NO: 7481 - DNA, 27 bp, Artificial Sequence
  Synthetic Oligonucleotide
agctgtatccaaggatgctccggaatg

SEQ ID NO: 7482 - DNA, 27 bp, Artificial Sequence
  Synthetic Oligonucleotide
taaacatggcttgaatgggatcttggt

SEQ ID NO: 7483 - DNA, 27 bp, Artificial Sequence
  Synthetic Oligonucleotide
acactgtgcagagggtgaccacagtct

SEQ ID NO: 7484 - DNA, 27 bp, Artificial Sequence
  Synthetic Oligonucleotide
gaggaaaaatcctttggccgtttccaa

SEQ ID NO: 7485 - DNA, 27 bp, Artificial Sequence
  Synthetic Oligonucleotide
gagagaattggaatgggtggcggtaat

SEQ ID NO: 7486 - DNA, 27 bp, Artificial Sequence
  Synthetic Oligonucleotide
tgaagaagtggcggaagctggtcctga

SEQ ID NO: 7487 - DNA, 27 bp, Artificial Sequence
  Synthetic Oligonucleotide
attccccacttcaatacaaagggtgtc

SEQ ID NO: 7488 - DNA, 27 bp, Artificial Sequence
  Synthetic Oligonucleotide
atactaaaggaagaattccggttggcc

SEQ ID NO: 7489 - DNA, 27 bp, Artificial Sequence
  Synthetic Oligonucleotide
tgtggaagggaaggtggaagtcttcct

SEQ ID NO: 7490 - DNA, 27 bp, Artificial Sequence
  Synthetic Oligonucleotide
tatgactattacaggtctggggcaaat

SEQ ID NO: 7491 - DNA, 27 bp, Artificial Sequence
  Synthetic Oligonucleotide
tgccactgtgagagcctgtcagtccct

SEQ ID NO: 7492 - DNA, 27 bp, Artificial Sequence
  Synthetic Oligonucleotide
attggaatgggtggcggtaattggtga

SEQ ID NO: 7493 - DNA, 27 bp, Artificial Sequence
  Synthetic Oligonucleotide
cctcaattgaagaagtggcggaagctg

SEQ ID NO: 7494 - DNA, 27 bp, Artificial Sequence
  Synthetic Oligonucleotide
caactcgatggggtgccagccactatt

SEQ ID NO: 7495 - DNA, 27 bp, Artificial Sequence
  Synthetic Oligonucleotide
cacctcctcaattgaagaagtggcgga

SEQ ID NO: 7496 - DNA, 27 bp, Artificial Sequence
  Synthetic Oligonucleotide
agaattggaatgggtggcggtaattgg

SEQ ID NO: 7497 - DNA, 27 bp, Artificial Sequence
  Synthetic Oligonucleotide
aggaaaaatcctttggccgtttccaag

SEQ ID NO: 7498 - DNA, 27 bp, Artificial Sequence
  Synthetic Oligonucleotide
ggaagggaaggtggaagtcttcctgga

SEQ ID NO: 7499 - DNA, 27 bp, Artificial Sequence
  Synthetic Oligonucleotide
atcagctgggaagatatcaaatggctg

SEQ ID NO: 7500 - DNA, 27 bp, Artificial Sequence
  Synthetic Oligonucleotide
ctcctcaattgaagaagtggcggaagc

SEQ ID NO: 7501 - DNA, 27 bp, Artificial Sequence
  Synthetic Oligonucleotide
cgacttctgttttaggacagagggtca

SEQ ID NO: 7502 - DNA, 27 bp, Artificial Sequence
  Synthetic Oligonucleotide
agcactggagagaattggaatgggtgg

SEQ ID NO: 7503 - DNA, 27 bp, Artificial Sequence
  Synthetic Oligonucleotide
accaatcgtttggggcttagctttcca

SEQ ID NO: 7504 - DNA, 27 bp, Artificial Sequence
  Synthetic Oligonucleotide
gggccacctcctcaattgaagaagtgg

SEQ ID NO: 7505 - DNA, 27 bp, Artificial Sequence
  Synthetic Oligonucleotide
gctgttaaacatggcttgaatgggatc

SEQ ID NO: 7506 - DNA, 27 bp, Artificial Sequence
  Synthetic Oligonucleotide
actgatgttctgaaagctctggctctt

SEQ ID NO: 7507 - DNA, 27 bp, Artificial Sequence
  Synthetic Oligonucleotide
gtgcgtaacagattcaaactgccgcca

SEQ ID NO: 7508 - DNA, 27 bp, Artificial Sequence
  Synthetic Oligonucleotide
gattcaaactgccgccacaactcagga

SEQ ID NO: 7509 - DNA, 27 bp, Artificial Sequence
  Synthetic Oligonucleotide
aattggaatgggtggcggtaattggtg

SEQ ID NO: 7510 - DNA, 27 bp, Artificial Sequence
  Synthetic Oligonucleotide
tgaggaaaaatcctttggccgtttcca

SEQ ID NO: 7511 - DNA, 27 bp, Artificial Sequence
  Synthetic Oligonucleotide
ctggcaggctaaagtgctgtatccttt

SEQ ID NO: 7512 - DNA, 27 bp, Artificial Sequence
  Synthetic Oligonucleotide
gatgatgccagggaggctgttaaacat

SEQ ID NO: 7513 - DNA, 27 bp, Artificial Sequence
  Synthetic Oligonucleotide
cttgccactgtgagagcctgtcagtcc

SEQ ID NO: 7514 - DNA, 27 bp, Artificial Sequence
  Synthetic Oligonucleotide
gcattttgagaggtgatgatgccaggg

SEQ ID NO: 7515 - DNA, 27 bp, Artificial Sequence
  Synthetic Oligonucleotide
agttcctgggccacctcctcaattgaa

SEQ ID NO: 7516 - DNA, 27 bp, Artificial Sequence
  Synthetic Oligonucleotide
atatatgactattacaggtctggggca

SEQ ID NO: 7517 - DNA, 27 bp, Artificial Sequence
  Synthetic Oligonucleotide
gacagtggacttgctgcatatgtggct

SEQ ID NO: 7518 - DNA, 27 bp, Artificial Sequence
  Synthetic Oligonucleotide
tgtttagacaacgtcatcccctggcag

SEQ ID NO: 7519 - DNA, 27 bp, Artificial Sequence
  Synthetic Oligonucleotide
tgttctgccagaaattgtggaggctgt

SEQ ID NO: 7520 - DNA, 27 bp, Artificial Sequence
  Synthetic Oligonucleotide
aactcgatggggtgccagccactattg

SEQ ID NO: 7521 - DNA, 27 bp, Artificial Sequence
  Synthetic Oligonucleotide
gagaagtcaccaagaagctagtgcggc

SEQ ID NO: 7522 - DNA, 27 bp, Artificial Sequence
  Synthetic Oligonucleotide
ggtgtgcggaaaggcactgatgttctg

SEQ ID NO: 7523 - DNA, 27 bp, Artificial Sequence
  Synthetic Oligonucleotide
ggaggctgttaaacatggcttgaatgg

SEQ ID NO: 7524 - DNA, 27 bp, Artificial Sequence
  Synthetic Oligonucleotide
ttgtggaggctgtggaagggaaggtgg

SEQ ID NO: 7525 - DNA, 27 bp, Artificial Sequence
  Synthetic Oligonucleotide
cttggtgtcgaatcatggggctcgaca

SEQ ID NO: 7526 - DNA, 27 bp, Artificial Sequence
  Synthetic Oligonucleotide
attcaaactgccgccacaactcaggat

SEQ ID NO: 7527 - DNA, 27 bp, Artificial Sequence
  Synthetic Oligonucleotide
gtgatgatgccagggaggctgttaaac

SEQ ID NO: 7528 - DNA, 27 bp, Artificial Sequence
  Synthetic Oligonucleotide
atatgactattacaggtctggggcaaa

SEQ ID NO: 7529 - DNA, 27 bp, Artificial Sequence
  Synthetic Oligonucleotide
tcgacaactcgatggggtgccagccac

SEQ ID NO: 7530 - DNA, 27 bp, Artificial Sequence
  Synthetic Oligonucleotide
ttggtgaggaaaaatcctttggccgtt

SEQ ID NO: 7531 - DNA, 27 bp, Artificial Sequence
  Synthetic Oligonucleotide
ctaaaggaagaattccggttggccatg

SEQ ID NO: 7532 - DNA, 27 bp, Artificial Sequence
  Synthetic Oligonucleotide
gcgtaacagattcaaactgccgccaca

SEQ ID NO: 7533 - DNA, 27 bp, Artificial Sequence
  Synthetic Oligonucleotide
gcttgccactgtgagagcctgtcagtc

SEQ ID NO: 7534 - DNA, 27 bp, Artificial Sequence
  Synthetic Oligonucleotide
cctgggaacgggcatgatgttgagttc

SEQ ID NO: 7535 - DNA, 27 bp, Artificial Sequence
  Synthetic Oligonucleotide
tctgccagaaattgtggaggctgtgga

SEQ ID NO: 7536 - DNA, 27 bp, Artificial Sequence
  Synthetic Oligonucleotide
tatatgactattacaggtctggggcaa

SEQ ID NO: 7537 - DNA, 27 bp, Artificial Sequence
  Synthetic Oligonucleotide
gaacgggcatgatgttgagttcctggg

SEQ ID NO: 7538 - DNA, 27 bp, Artificial Sequence
  Synthetic Oligonucleotide
gaggctgttaaacatggcttgaatggg

SEQ ID NO: 7539 - DNA, 27 bp, Artificial Sequence
  Synthetic Oligonucleotide
ggcactgatgttctgaaagctctggct

SEQ ID NO: 7540 - DNA, 27 bp, Artificial Sequence
  Synthetic Oligonucleotide
atgggatcttggtgtcgaatcatgggg

SEQ ID NO: 7541 - DNA, 27 bp, Artificial Sequence
  Synthetic Oligonucleotide
agaccaatcgtttggggcttagctttc

SEQ ID NO: 7542 - DNA, 27 bp, Artificial Sequence
  Synthetic Oligonucleotide
tagacaacgtcatcccctggcaggcta

SEQ ID NO: 7543 - DNA, 27 bp, Artificial Sequence
  Synthetic Oligonucleotide
actgtgcagagggtgaccacagtctgt

SEQ ID NO: 7544 - DNA, 27 bp, Artificial Sequence
  Synthetic Oligonucleotide
actcgatggggtgccagccactattga

SEQ ID NO: 7545 - DNA, 27 bp, Artificial Sequence
  Synthetic Oligonucleotide
ttacctgggcaaccgtctggatgatgt

SEQ ID NO: 7546 - DNA, 27 bp, Artificial Sequence
  Synthetic Oligonucleotide
tggaagctgtatccaaggatgctccgg

SEQ ID NO: 7547 - DNA, 27 bp, Artificial Sequence
  Synthetic Oligonucleotide
tggtgtcgaatcatggggctcgacaac

SEQ ID NO: 7548 - DNA, 27 bp, Artificial Sequence
  Synthetic Oligonucleotide
atgactattacaggtctggggcaaatg

SEQ ID NO: 7549 - DNA, 27 bp, Artificial Sequence
  Synthetic Oligonucleotide
tacctgggcaaccgtctggatgatgtg

SEQ ID NO: 7550 - DNA, 27 bp, Artificial Sequence
  Synthetic Oligonucleotide
gtgtcgaatcatggggctcgacaactc

SEQ ID NO: 7551 - DNA, 27 bp, Artificial Sequence
  Synthetic Oligonucleotide
ggccacctcctcaattgaagaagtggc

SEQ ID NO: 7552 - DNA, 27 bp, Artificial Sequence
  Synthetic Oligonucleotide
gaggctgtggaagggaaggtggaagtc

SEQ ID NO: 7553 - DNA, 27 bp, Artificial Sequence
  Synthetic Oligonucleotide
gttttaggacagagggtcagcatgcca

SEQ ID NO: 7554 - DNA, 27 bp, Artificial Sequence
  Synthetic Oligonucleotide
ggaaaaatcctttggccgtttccaaga

SEQ ID NO: 7555 - DNA, 27 bp, Artificial Sequence
  Synthetic Oligonucleotide
ctgatgttctgaaagctctggctcttg

SEQ ID NO: 7556 - DNA, 27 bp, Artificial Sequence
  Synthetic Oligonucleotide
gacttctgttttaggacagagggtcag

SEQ ID NO: 7557 - DNA, 27 bp, Artificial Sequence
  Synthetic Oligonucleotide
aagggaaggtggaagtcttcctggacg

SEQ ID NO: 7558 - DNA, 27 bp, Artificial Sequence
  Synthetic Oligonucleotide
tttctcctgaggaaaattttggagacg

SEQ ID NO: 7559 - DNA, 27 bp, Artificial Sequence
  Synthetic Oligonucleotide
caagaagctagtgcggcaggcagagaa

SEQ ID NO: 7560 - DNA, 27 bp, Artificial Sequence
  Synthetic Oligonucleotide
gctgtggaagggaaggtggaagtcttc

SEQ ID NO: 7561 - DNA, 27 bp, Artificial Sequence
  Synthetic Oligonucleotide
ctgaggcacttcgttggctgcaactgt

SEQ ID NO: 7562 - DNA, 27 bp, Artificial Sequence
  Synthetic Oligonucleotide
tgtgcgtaacagattcaaactgccgcc

SEQ ID NO: 7563 - DNA, 27 bp, Artificial Sequence
  Synthetic Oligonucleotide
tcctttggccgtttccaagatctgaca

SEQ ID NO: 7564 - DNA, 27 bp, Artificial Sequence
  Synthetic Oligonucleotide
tgtcgaatcatggggctcgacaactcg

SEQ ID NO: 7565 - DNA, 27 bp, Artificial Sequence
  Synthetic Oligonucleotide
tttggccgtttccaagatctgacagtg

SEQ ID NO: 7566 - DNA, 27 bp, Artificial Sequence
  Synthetic Oligonucleotide
aacgtcatcccctggcaggctaaagtg

SEQ ID NO: 7567 - DNA, 27 bp, Artificial Sequence
  Synthetic Oligonucleotide
tggtgaggaaaaatcctttggccgttt

SEQ ID NO: 7568 - DNA, 27 bp, Artificial Sequence
  Synthetic Oligonucleotide
ggtgatgatgccagggaggctgttaaa

SEQ ID NO: 7569 - DNA, 27 bp, Artificial Sequence
  Synthetic Oligonucleotide
actaaaggaagaattccggttggccat

SEQ ID NO: 7570 - DNA, 27 bp, Artificial Sequence
  Synthetic Oligonucleotide
acttctgttttaggacagagggtcagc

SEQ ID NO: 7571 - DNA, 27 bp, Artificial Sequence
  Synthetic Oligonucleotide
cctttggccgtttccaagatctgacag

SEQ ID NO: 7572 - DNA, 27 bp, Artificial Sequence
  Synthetic Oligonucleotide
ccacctcctcaattgaagaagtggcgg

SEQ ID NO: 7573 - DNA, 27 bp, Artificial Sequence
  Synthetic Oligonucleotide
atcctttggccgtttccaagatctgac

SEQ ID NO: 7574 - DNA, 27 bp, Artificial Sequence
  Synthetic Oligonucleotide
ggtgtcgaatcatggggctcgacaact

SEQ ID NO: 7575 - DNA, 27 bp, Artificial Sequence
  Synthetic Oligonucleotide
ggaggctgtggaagggaaggtggaagt

SEQ ID NO: 7576 - DNA, 27 bp, Artificial Sequence
  Synthetic Oligonucleotide
attgtggaggctgtggaagggaaggtg

SEQ ID NO: 7577 - DNA, 27 bp, Artificial Sequence
  Synthetic Oligonucleotide
ccaatcgtttggggcttagctttccag

SEQ ID NO: 7578 - DNA, 27 bp, Artificial Sequence
  Synthetic Oligonucleotide
gccagaaattgtggaggctgtggaagg

SEQ ID NO: 7579 - DNA, 27 bp, Artificial Sequence
  Synthetic Oligonucleotide
acctgggcaaccgtctggatgatgtgc

SEQ ID NO: 7580 - DNA, 27 bp, Artificial Sequence
  Synthetic Oligonucleotide
cggaagctggtcctgaggcacttcgtt

SEQ ID NO: 7581 - DNA, 27 bp, Artificial Sequence
  Synthetic Oligonucleotide
aaacatggcttgaatgggatcttggtg

SEQ ID NO: 7582 - DNA, 27 bp, Artificial Sequence
  Synthetic Oligonucleotide
gaggcacttcgttggctgcaactgtat

SEQ ID NO: 7583 - DNA, 27 bp, Artificial Sequence
  Synthetic Oligonucleotide
ctgtgagagcctgtcagtccctgggaa

SEQ ID NO: 7584 - DNA, 27 bp, Artificial Sequence
  Synthetic Oligonucleotide
tgatgccagggaggctgttaaacatgg

SEQ ID NO: 7585 - DNA, 27 bp, Artificial Sequence
  Synthetic Oligonucleotide
cattggtgaggaaaaatcctttggccg

SEQ ID NO: 7586 - DNA, 27 bp, Artificial Sequence
  Synthetic Oligonucleotide
gccactgtgagagcctgtcagtccctg

SEQ ID NO: 7587 - DNA, 27 bp, Artificial Sequence
  Synthetic Oligonucleotide
tggacggcgagcttgccactgtgagag

SEQ ID NO: 7588 - DNA, 27 bp, Artificial Sequence
  Synthetic Oligonucleotide
ggaagctggtcctgaggcacttcgttg

SEQ ID NO: 7589 - DNA, 27 bp, Artificial Sequence
  Synthetic Oligonucleotide
tccctgggaacgggcatgatgttgagt

SEQ ID NO: 7590 - DNA, 27 bp, Artificial Sequence
  Synthetic Oligonucleotide
aatgggatcttggtgtcgaatcatggg

SEQ ID NO: 7591 - DNA, 27 bp, Artificial Sequence
  Synthetic Oligonucleotide
gagttcctgggccacctcctcaattga

SEQ ID NO: 7592 - DNA, 27 bp, Artificial Sequence
  Synthetic Oligonucleotide
gaaaaatcctttggccgtttccaagat

SEQ ID NO: 7593 - DNA, 27 bp, Artificial Sequence
  Synthetic Oligonucleotide
gaagggaaggtggaagtcttcctggac

SEQ ID NO: 7594 - DNA, 27 bp, Artificial Sequence
  Synthetic Oligonucleotide
ttgagttcctgggccacctcctcaatt

SEQ ID NO: 7595 - DNA, 27 bp, Artificial Sequence
  Synthetic Oligonucleotide
caattgaagaagtggcggaagctggtc

SEQ ID NO: 7596 - DNA, 27 bp, Artificial Sequence
  Synthetic Oligonucleotide
caatcgtttggggcttagctttccagg

SEQ ID NO: 7597 - DNA, 27 bp, Artificial Sequence
  Synthetic Oligonucleotide
ctttggccgtttccaagatctgacagt

SEQ ID NO: 7598 - DNA, 27 bp, Artificial Sequence
  Synthetic Oligonucleotide
aaggaagaattccggttggccatggct

SEQ ID NO: 7599 - DNA, 27 bp, Artificial Sequence
  Synthetic Oligonucleotide
ccagggaggctgttaaacatggcttga

SEQ ID NO: 7600 - DNA, 27 bp, Artificial Sequence
  Synthetic Oligonucleotide
gtgtttgtggggagaccaatcgtttgg

SEQ ID NO: 7601 - DNA, 27 bp, Artificial Sequence
  Synthetic Oligonucleotide
ccagaaattgtggaggctgtggaaggg

SEQ ID NO: 7602 - DNA, 27 bp, Artificial Sequence
  Synthetic Oligonucleotide
ggcaggctaaagtgctgtatcctttag

SEQ ID NO: 7603 - DNA, 27 bp, Artificial Sequence
  Synthetic Oligonucleotide
cagagaagatgggctacaaggccatat

SEQ ID NO: 7604 - DNA, 27 bp, Artificial Sequence
  Synthetic Oligonucleotide
agaagtcaccaagaagctagtgcggca

SEQ ID NO: 7605 - DNA, 27 bp, Artificial Sequence
  Synthetic Oligonucleotide
atgtggacggcgagcttgccactgtga

SEQ ID NO: 7606 - DNA, 27 bp, Artificial Sequence
  Synthetic Oligonucleotide
ccactgtgagagcctgtcagtccctgg

SEQ ID NO: 7607 - DNA, 27 bp, Artificial Sequence
  Synthetic Oligonucleotide
acttttcaatgggtgtcctaggaacct

SEQ ID NO: 7608 - DNA, 27 bp, Artificial Sequence
  Synthetic Oligonucleotide
gctgtatccaaggatgctccggaatgt

SEQ ID NO: 7609 - DNA, 27 bp, Artificial Sequence
  Synthetic Oligonucleotide
atgttgagttcctgggccacctcctca

SEQ ID NO: 7610 - DNA, 27 bp, Artificial Sequence
  Synthetic Oligonucleotide
aaaaatcctttggccgtttccaagatc

SEQ ID NO: 7611 - DNA, 27 bp, Artificial Sequence
  Synthetic Oligonucleotide
cctggcaggctaaagtgctgtatcctt

SEQ ID NO: 7612 - DNA, 27 bp, Artificial Sequence
  Synthetic Oligonucleotide
aaaatcctttggccgtttccaagatct

SEQ ID NO: 7613 - DNA, 27 bp, Artificial Sequence
  Synthetic Oligonucleotide
gaaattgtggaggctgtggaagggaag

SEQ ID NO: 7614 - DNA, 27 bp, Artificial Sequence
  Synthetic Oligonucleotide
ctggagagaattggaatgggtggcggt

SEQ ID NO: 7615 - DNA, 27 bp, Artificial Sequence
  Synthetic Oligonucleotide
atgatgttgagttcctgggccacctcc

SEQ ID NO: 7616 - DNA, 27 bp, Artificial Sequence
  Synthetic Oligonucleotide
gatgttctgccagaaattgtggaggct

SEQ ID NO: 7617 - DNA, 27 bp, Artificial Sequence
  Synthetic Oligonucleotide
agaagctagtgcggcaggcagagaaga

SEQ ID NO: 7618 - DNA, 27 bp, Artificial Sequence
  Synthetic Oligonucleotide
tcgaatcatggggctcgacaactcgat

SEQ ID NO: 7619 - DNA, 27 bp, Artificial Sequence
  Synthetic Oligonucleotide
tgccagggaggctgttaaacatggctt

SEQ ID NO: 7620 - DNA, 27 bp, Artificial Sequence
  Synthetic Oligonucleotide
cactggagagaattggaatgggtggcg

SEQ ID NO: 7621 - DNA, 27 bp, Artificial Sequence
  Synthetic Oligonucleotide
gcagagaagatgggctacaaggccata

SEQ ID NO: 7622 - DNA, 27 bp, Artificial Sequence
  Synthetic Oligonucleotide
ggagaccaatcgtttggggcttagctt

SEQ ID NO: 7623 - DNA, 27 bp, Artificial Sequence
  Synthetic Oligonucleotide
aattgtggaggctgtggaagggaaggt

SEQ ID NO: 7624 - DNA, 27 bp, Artificial Sequence
  Synthetic Oligonucleotide
cgaatcatggggctcgacaactcgatg

SEQ ID NO: 7625 - DNA, 27 bp, Artificial Sequence
  Synthetic Oligonucleotide
gtcctgaggcacttcgttggctgcaac

SEQ ID NO: 7626 - DNA, 27 bp, Artificial Sequence
  Synthetic Oligonucleotide
agtccctgggaacgggcatgatgttga

SEQ ID NO: 7627 - DNA, 27 bp, Artificial Sequence
  Synthetic Oligonucleotide
actgtgagagcctgtcagtccctggga

SEQ ID NO: 7628 - DNA, 27 bp, Artificial Sequence
  Synthetic Oligonucleotide
tggagagaattggaatgggtggcggta

SEQ ID NO: 7629 - DNA, 27 bp, Artificial Sequence
  Synthetic Oligonucleotide
atggctctgagtgggtgccagaatgtg

SEQ ID NO: 7630 - DNA, 27 bp, Artificial Sequence
  Synthetic Oligonucleotide
gaagtcaccaagaagctagtgcggcag

SEQ ID NO: 7631 - DNA, 27 bp, Artificial Sequence
  Synthetic Oligonucleotide
taaaggaagaattccggttggccatgg

SEQ ID NO: 7632 - DNA, 27 bp, Artificial Sequence
  Synthetic Oligonucleotide
ttggccgtttccaagatctgacagtgc

SEQ ID NO: 7633 - DNA, 27 bp, Artificial Sequence
  Synthetic Oligonucleotide
aatcctttggccgtttccaagatctga

SEQ ID NO: 7634 - DNA, 27 bp, Artificial Sequence
  Synthetic Oligonucleotide
cggcaggcagagaagatgggctacaag

SEQ ID NO: 7635 - DNA, 27 bp, Artificial Sequence
  Synthetic Oligonucleotide
tgtgagagcctgtcagtccctgggaac

SEQ ID NO: 7636 - DNA, 27 bp, Artificial Sequence
  Synthetic Oligonucleotide
gttctgccagaaattgtggaggctgtg

SEQ ID NO: 7637 - DNA, 27 bp, Artificial Sequence
  Synthetic Oligonucleotide
aagaagctagtgcggcaggcagagaag

SEQ ID NO: 7638 - DNA, 27 bp, Artificial Sequence
  Synthetic Oligonucleotide
agattcaaactgccgccacaactcagg

SEQ ID NO: 7639 - DNA, 27 bp, Artificial Sequence
  Synthetic Oligonucleotide
tgtttgtggggagaccaatcgtttggg

SEQ ID NO: 7640 - DNA, 27 bp, Artificial Sequence
  Synthetic Oligonucleotide
tgttttaggacagagggtcagcatgcc

SEQ ID NO: 7641 - DNA, 27 bp, Artificial Sequence
  Synthetic Oligonucleotide
agggaaggtggaagtcttcctggacgg

SEQ ID NO: 7642 - DNA, 27 bp, Artificial Sequence
  Synthetic Oligonucleotide
attggtgaggaaaaatcctttggccgt

SEQ ID NO: 7643 - DNA, 27 bp, Artificial Sequence
  Synthetic Oligonucleotide
agacaacgtcatcccctggcaggctaa

SEQ ID NO: 7644 - DNA, 27 bp, Artificial Sequence
  Synthetic Oligonucleotide
gtttagacaacgtcatcccctggcagg

SEQ ID NO: 7645 - DNA, 27 bp, Artificial Sequence
  Synthetic Oligonucleotide
ggtgaggaaaaatcctttggccgtttc

SEQ ID NO: 7646 - DNA, 27 bp, Artificial Sequence
  Synthetic Oligonucleotide
ggcaggcagagaagatgggctacaagg

SEQ ID NO: 7647 - DNA, 27 bp, Artificial Sequence
  Synthetic Oligonucleotide
gccacctcctcaattgaagaagtggcg

SEQ ID NO: 7648 - DNA, 27 bp, Artificial Sequence
  Synthetic Oligonucleotide
catgatgttgagttcctgggccacctc

SEQ ID NO: 7649 - DNA, 27 bp, Artificial Sequence
  Synthetic Oligonucleotide
ggagagaattggaatgggtggcggtaa

SEQ ID NO: 7650 - DNA, 27 bp, Artificial Sequence
  Synthetic Oligonucleotide
cctcctcaattgaagaagtggcggaag

SEQ ID NO: 7651 - DNA, 27 bp, Artificial Sequence
  Synthetic Oligonucleotide
actggagagaattggaatgggtggcgg

SEQ ID NO: 7652 - DNA, 27 bp, Artificial Sequence
  Synthetic Oligonucleotide
tcccctggcaggctaaagtgctgtatc

SEQ ID NO: 7653 - DNA, 27 bp, Artificial Sequence
  Synthetic Oligonucleotide
tggaggctgtggaagggaaggtggaag

SEQ ID NO: 7654 - DNA, 27 bp, Artificial Sequence
  Synthetic Oligonucleotide
catggctctgagtgggtgccagaatgt

SEQ ID NO: 7655 - DNA, 27 bp, Artificial Sequence
  Synthetic Oligonucleotide
aagtcaccaagaagctagtgcggcagg

SEQ ID NO: 7656 - DNA, 27 bp, Artificial Sequence
  Synthetic Oligonucleotide
ttgaagaagtggcggaagctggtcctg

SEQ ID NO: 7657 - DNA, 27 bp, Artificial Sequence
  Synthetic Oligonucleotide
tgagttcctgggccacctcctcaattg

SEQ ID NO: 7658 - DNA, 27 bp, Artificial Sequence
  Synthetic Oligonucleotide
tcctgaggcacttcgttggctgcaact

SEQ ID NO: 7659 - DNA, 27 bp, Artificial Sequence
  Synthetic Oligonucleotide
gttcctgggccacctcctcaattgaag

SEQ ID NO: 7660 - DNA, 27 bp, Artificial Sequence
  Synthetic Oligonucleotide
tgtggaggctgtggaagggaaggtgga

SEQ ID NO: 7661 - DNA, 27 bp, Artificial Sequence
  Synthetic Oligonucleotide
atcttggtgtcgaatcatggggctcga

SEQ ID NO: 7662 - DNA, 27 bp, Artificial Sequence
  Synthetic Oligonucleotide
gtggaggctgtggaagggaaggtggaa

SEQ ID NO: 7663 - DNA, 27 bp, Artificial Sequence
  Synthetic Oligonucleotide
tgggatcttggtgtcgaatcatggggc

SEQ ID NO: 7664 - DNA, 27 bp, Artificial Sequence
  Synthetic Oligonucleotide
gtccctgggaacgggcatgatgttgag

SEQ ID NO: 7665 - DNA, 27 bp, Artificial Sequence
  Synthetic Oligonucleotide
ttttgagaggtgatgatgccagggagg

SEQ ID NO: 7666 - DNA, 27 bp, Artificial Sequence
  Synthetic Oligonucleotide
catggcttgaatgggatcttggtgtcg

SEQ ID NO: 7667 - DNA, 27 bp, Artificial Sequence
  Synthetic Oligonucleotide
ccatggctctgagtgggtgccagaatg

SEQ ID NO: 7668 - DNA, 27 bp, Artificial Sequence
  Synthetic Oligonucleotide
gagaggtgatgatgccagggaggctgt

SEQ ID NO: 7669 - DNA, 27 bp, Artificial Sequence
  Synthetic Oligonucleotide
gcgagcttgccactgtgagagcctgtc

SEQ ID NO: 7670 - DNA, 27 bp, Artificial Sequence
  Synthetic Oligonucleotide
tgttgagttcctgggccacctcctcaa

SEQ ID NO: 7671 - DNA, 27 bp, Artificial Sequence
  Synthetic Oligonucleotide
cggcgagcttgccactgtgagagcctg

SEQ ID NO: 7672 - DNA, 27 bp, Artificial Sequence
  Synthetic Oligonucleotide
catgtggacggcgagcttgccactgtg

SEQ ID NO: 7673 - DNA, 27 bp, Artificial Sequence
  Synthetic Oligonucleotide
aaattgtggaggctgtggaagggaagg

SEQ ID NO: 7674 - DNA, 27 bp, Artificial Sequence
  Synthetic Oligonucleotide
aattgaagaagtggcggaagctggtcc

SEQ ID NO: 7675 - DNA, 27 bp, Artificial Sequence
  Synthetic Oligonucleotide
gacaactcgatggggtgccagccacta

SEQ ID NO: 7676 - DNA, 27 bp, Artificial Sequence
  Synthetic Oligonucleotide
aggaagaattccggttggccatggctc

SEQ ID NO: 7677 - DNA, 27 bp, Artificial Sequence
  Synthetic Oligonucleotide
aggcagagaagatgggctacaaggcca

SEQ ID NO: 7678 - DNA, 27 bp, Artificial Sequence
  Synthetic Oligonucleotide
gaccaatcgtttggggcttagctttcc

SEQ ID NO: 7679 - DNA, 27 bp, Artificial Sequence
  Synthetic Oligonucleotide
gtgaggaaaaatcctttggccgtttcc

SEQ ID NO: 7680 - DNA, 27 bp, Artificial Sequence
  Synthetic Oligonucleotide
caacgtcatcccctggcaggctaaagt

SEQ ID NO: 7681 - DNA, 27 bp, Artificial Sequence
  Synthetic Oligonucleotide
cactgtgagagcctgtcagtccctggg

SEQ ID NO: 7682 - DNA, 27 bp, Artificial Sequence
  Synthetic Oligonucleotide
acgtcatcccctggcaggctaaagtgc

SEQ ID NO: 7683 - DNA, 27 bp, Artificial Sequence
  Synthetic Oligonucleotide
gacaacgtcatcccctggcaggctaaa

SEQ ID NO: 7684 - DNA, 27 bp, Artificial Sequence
  Synthetic Oligonucleotide
gaatcatggggctcgacaactcgatgg

SEQ ID NO: 7685 - DNA, 27 bp, Artificial Sequence
  Synthetic Oligonucleotide
aaatcctttggccgtttccaagatctg

SEQ ID NO: 7686 - DNA, 27 bp, Artificial Sequence
  Synthetic Oligonucleotide
cccctggcaggctaaagtgctgtatcc

SEQ ID NO: 7687 - DNA, 27 bp, Artificial Sequence
  Synthetic Oligonucleotide
tcttggtgtcgaatcatggggctcgac

SEQ ID NO: 7688 - DNA, 27 bp, Artificial Sequence
  Synthetic Oligonucleotide
tcatgtggacggcgagcttgccactgt

SEQ ID NO: 7689 - DNA, 27 bp, Artificial Sequence
  Synthetic Oligonucleotide
aagaattccggttggccatggctctga

SEQ ID NO: 7690 - DNA, 27 bp, Artificial Sequence
  Synthetic Oligonucleotide
tcaccaagaagctagtgcggcaggcag

SEQ ID NO: 7691 - DNA, 27 bp, Artificial Sequence
  Synthetic Oligonucleotide
ggaaggtggaagtcttcctggacgggg

SEQ ID NO: 7692 - DNA, 27 bp, Artificial Sequence
  Synthetic Oligonucleotide
tgatgttgagttcctgggccacctcct

SEQ ID NO: 7693 - DNA, 27 bp, Artificial Sequence
  Synthetic Oligonucleotide
accttacctgggcaaccgtctggatga

SEQ ID NO: 7694 - DNA, 27 bp, Artificial Sequence
  Synthetic Oligonucleotide
cgacaactcgatggggtgccagccact

SEQ ID NO: 7695 - DNA, 27 bp, Artificial Sequence
  Synthetic Oligonucleotide
tgagaggtgatgatgccagggaggctg

SEQ ID NO: 7696 - DNA, 27 bp, Artificial Sequence
  Synthetic Oligonucleotide
ctgggcaaccgtctggatgatgtgcgt

SEQ ID NO: 7697 - DNA, 27 bp, Artificial Sequence
  Synthetic Oligonucleotide
ccctggcaggctaaagtgctgtatcct

SEQ ID NO: 7698 - DNA, 27 bp, Artificial Sequence
  Synthetic Oligonucleotide
ggcgagcttgccactgtgagagcctgt

SEQ ID NO: 7699 - DNA, 27 bp, Artificial Sequence
  Synthetic Oligonucleotide
gaagaagtggcggaagctggtcctgag

SEQ ID NO: 7700 - DNA, 27 bp, Artificial Sequence
  Synthetic Oligonucleotide
agctagtgcggcaggcagagaagatgg

SEQ ID NO: 7701 - DNA, 27 bp, Artificial Sequence
  Synthetic Oligonucleotide
gtttgtggggagaccaatcgtttgggg

SEQ ID NO: 7702 - DNA, 27 bp, Artificial Sequence
  Synthetic Oligonucleotide
agaattccggttggccatggctctgag

SEQ ID NO: 7703 - DNA, 27 bp, Artificial Sequence
  Synthetic Oligonucleotide
gcatgatgttgagttcctgggccacct

SEQ ID NO: 7704 - DNA, 27 bp, Artificial Sequence
  Synthetic Oligonucleotide
gaggtgatgatgccagggaggctgtta

SEQ ID NO: 7705 - DNA, 27 bp, Artificial Sequence
  Synthetic Oligonucleotide
gaagctagtgcggcaggcagagaagat

SEQ ID NO: 7706 - DNA, 27 bp, Artificial Sequence
  Synthetic Oligonucleotide
acaactcgatggggtgccagccactat

SEQ ID NO: 7707 - DNA, 27 bp, Artificial Sequence
  Synthetic Oligonucleotide
ggacggcgagcttgccactgtgagagc

SEQ ID NO: 7708 - DNA, 27 bp, Artificial Sequence
  Synthetic Oligonucleotide
aaaggaagaattccggttggccatggc

SEQ ID NO: 7709 - DNA, 27 bp, Artificial Sequence
  Synthetic Oligonucleotide
ggctcgacaactcgatggggtgccagc

SEQ ID NO: 7710 - DNA, 27 bp, Artificial Sequence
  Synthetic Oligonucleotide
gcactggagagaattggaatgggtggc

SEQ ID NO: 7711 - DNA, 27 bp, Artificial Sequence
  Synthetic Oligonucleotide
agaggtgatgatgccagggaggctgtt

SEQ ID NO: 7712 - DNA, 27 bp, Artificial Sequence
  Synthetic Oligonucleotide
ttctgccagaaattgtggaggctgtgg

SEQ ID NO: 7713 - DNA, 27 bp, Artificial Sequence
  Synthetic Oligonucleotide
attgaagaagtggcggaagctggtcct

SEQ ID NO: 7714 - DNA, 27 bp, Artificial Sequence
  Synthetic Oligonucleotide
gggagaccaatcgtttggggcttagct

SEQ ID NO: 7715 - DNA, 27 bp, Artificial Sequence
  Synthetic Oligonucleotide
gtggacggcgagcttgccactgtgaga

SEQ ID NO: 7716 - DNA, 27 bp, Artificial Sequence
  Synthetic Oligonucleotide
cacaccttacctgggcaaccgtctgga

SEQ ID NO: 7717 - DNA, 27 bp, Artificial Sequence
  Synthetic Oligonucleotide
gggatcttggtgtcgaatcatggggct

SEQ ID NO: 7718 - DNA, 27 bp, Artificial Sequence
  Synthetic Oligonucleotide
caccaagaagctagtgcggcaggcaga

SEQ ID NO: 7719 - DNA, 27 bp, Artificial Sequence
  Synthetic Oligonucleotide
gttgagttcctgggccacctcctcaat

SEQ ID NO: 7720 - DNA, 27 bp, Artificial Sequence
  Synthetic Oligonucleotide
tcagtccctgggaacgggcatgatgtt

SEQ ID NO: 7721 - DNA, 27 bp, Artificial Sequence
  Synthetic Oligonucleotide
ctcgacaactcgatggggtgccagcca

SEQ ID NO: 7722 - DNA, 27 bp, Artificial Sequence
  Synthetic Oligonucleotide
ggatcttggtgtcgaatcatggggctc

SEQ ID NO: 7723 - DNA, 27 bp, Artificial Sequence
  Synthetic Oligonucleotide
aagctagtgcggcaggcagagaagatg

SEQ ID NO: 7724 - DNA, 27 bp, Artificial Sequence
  Synthetic Oligonucleotide
gacggcgagcttgccactgtgagagcc

SEQ ID NO: 7725 - DNA, 27 bp, Artificial Sequence
  Synthetic Oligonucleotide
cctgaggcacttcgttggctgcaactg

SEQ ID NO: 7726 - DNA, 27 bp, Artificial Sequence
  Synthetic Oligonucleotide
cgggcatgatgttgagttcctgggcca

SEQ ID NO: 7727 - DNA, 27 bp, Artificial Sequence
  Synthetic Oligonucleotide
acggcgagcttgccactgtgagagcct

SEQ ID NO: 7728 - DNA, 27 bp, Artificial Sequence
  Synthetic Oligonucleotide
gtgagagcctgtcagtccctgggaacg

SEQ ID NO: 7729 - DNA, 27 bp, Artificial Sequence
  Synthetic Oligonucleotide
tgtcagtccctgggaacgggcatgatg

SEQ ID NO: 7730 - DNA, 27 bp, Artificial Sequence
  Synthetic Oligonucleotide
ggccgtttccaagatctgacagtgcac

SEQ ID NO: 7731 - DNA, 27 bp, Artificial Sequence
  Synthetic Oligonucleotide
ggcagagaagatgggctacaaggccat

SEQ ID NO: 7732 - DNA, 27 bp, Artificial Sequence
  Synthetic Oligonucleotide
aacgggcatgatgttgagttcctgggc

SEQ ID NO: 7733 - DNA, 27 bp, Artificial Sequence
  Synthetic Oligonucleotide
cttacctgggcaaccgtctggatgatg

SEQ ID NO: 7734 - DNA, 27 bp, Artificial Sequence
  Synthetic Oligonucleotide
cagtccctgggaacgggcatgatgttg

SEQ ID NO: 7735 - DNA, 27 bp, Artificial Sequence
  Synthetic Oligonucleotide
gaagctggtcctgaggcacttcgttgg

SEQ ID NO: 7736 - DNA, 27 bp, Artificial Sequence
  Synthetic Oligonucleotide
gggaaggtggaagtcttcctggacggg

SEQ ID NO: 7737 - DNA, 27 bp, Artificial Sequence
  Synthetic Oligonucleotide
gtcagtccctgggaacgggcatgatgt

SEQ ID NO: 7738 - DNA, 27 bp, Artificial Sequence
  Synthetic Oligonucleotide
tgagagcctgtcagtccctgggaacgg

SEQ ID NO: 7739 - DNA, 27 bp, Artificial Sequence
  Synthetic Oligonucleotide
caccttacctgggcaaccgtctggatg

SEQ ID NO: 7740 - DNA, 27 bp, Artificial Sequence
  Synthetic Oligonucleotide
tcatggggctcgacaactcgatggggt

SEQ ID NO: 7741 - DNA, 27 bp, Artificial Sequence
  Synthetic Oligonucleotide
ccatgcagcgcatggctcatgtggacg

SEQ ID NO: 7742 - DNA, 27 bp, Artificial Sequence
  Synthetic Oligonucleotide
ggggagaccaatcgtttggggcttagc

SEQ ID NO: 7743 - DNA, 27 bp, Artificial Sequence
  Synthetic Oligonucleotide
tcatcccctggcaggctaaagtgctgt

SEQ ID NO: 7744 - DNA, 27 bp, Artificial Sequence
  Synthetic Oligonucleotide
ttgtggggagaccaatcgtttggggct

SEQ ID NO: 7745 - DNA, 27 bp, Artificial Sequence
  Synthetic Oligonucleotide
ccaagaagctagtgcggcaggcagaga

SEQ ID NO: 7746 - DNA, 27 bp, Artificial Sequence
  Synthetic Oligonucleotide
acaacgtcatcccctggcaggctaaag

SEQ ID NO: 7747 - DNA, 27 bp, Artificial Sequence
  Synthetic Oligonucleotide
acgggcatgatgttgagttcctgggcc

SEQ ID NO: 7748 - DNA, 27 bp, Artificial Sequence
  Synthetic Oligonucleotide
tttgagaggtgatgatgccagggaggc

SEQ ID NO: 7749 - DNA, 27 bp, Artificial Sequence
  Synthetic Oligonucleotide
atgttctgaaagctctggctcttggcg

SEQ ID NO: 7750 - DNA, 27 bp, Artificial Sequence
  Synthetic Oligonucleotide
tgtggacggcgagcttgccactgtgag

SEQ ID NO: 7751 - DNA, 27 bp, Artificial Sequence
  Synthetic Oligonucleotide
gccagggaggctgttaaacatggcttg

SEQ ID NO: 7752 - DNA, 27 bp, Artificial Sequence
  Synthetic Oligonucleotide
ttagacaacgtcatcccctggcaggct

SEQ ID NO: 7753 - DNA, 27 bp, Artificial Sequence
  Synthetic Oligonucleotide
cctgggcaaccgtctggatgatgtgcg

SEQ ID NO: 7754 - DNA, 27 bp, Artificial Sequence
  Synthetic Oligonucleotide
catcccctggcaggctaaagtgctgta

SEQ ID NO: 7755 - RNA, 21 nt, Artificial Sequence
  Synthetic Oligonucleotide
cuggaaauauauuaacuguua

SEQ ID NO: 7756 - RNA, 21 nt, Artificial Sequence
  Synthetic Oligonucleotide
uaaugaucucauuguuuauua

SEQ ID NO: 7757 - RNA, 21 nt, Artificial Sequence
  Synthetic Oligonucleotide
aagauaaugaucucauuguuu

SEQ ID NO: 7758 - RNA, 21 nt, Artificial Sequence
  Synthetic Oligonucleotide
uggaaauauauuaacuguuaa

SEQ ID NO: 7759 - RNA, 21 nt, Artificial Sequence
  Synthetic Oligonucleotide
uucagcauguauuacuugaca

SEQ ID NO: 7760 - RNA, 21 nt, Artificial Sequence
  Synthetic Oligonucleotide
uccuggaaauauauuaacugu

SEQ ID NO: 7761 - RNA, 21 nt, Artificial Sequence
  Synthetic Oligonucleotide
aaagauaaugaucucauuguu

SEQ ID NO: 7762 - RNA, 21 nt, Artificial Sequence
  Synthetic Oligonucleotide
aaauuuugaaaccaguacuuu

SEQ ID NO: 7763 - RNA, 21 nt, Artificial Sequence
  Synthetic Oligonucleotide
uugaaaccaguacuuuaucau

SEQ ID NO: 7764 - RNA, 21 nt, Artificial Sequence
  Synthetic Oligonucleotide
ccuggaaauauauuaacuguu

SEQ ID NO: 7765 - RNA, 21 nt, Artificial Sequence
  Synthetic Oligonucleotide
aacaaaauagcaaucccuuuu

SEQ ID NO: 7766 - RNA, 21 nt, Artificial Sequence
  Synthetic Oligonucleotide
auaaugaucucauuguuuauu

SEQ ID NO: 7767 - RNA, 21 nt, Artificial Sequence
  Synthetic Oligonucleotide
aacagugguucuuaaauugua

SEQ ID NO: 7768 - RNA, 21 nt, Artificial Sequence
  Synthetic Oligonucleotide
ggacuuucauccuggaaauau

SEQ ID NO: 7769 - RNA, 21 nt, Artificial Sequence
  Synthetic Oligonucleotide
uuaugaacaacaugcuaaauc

SEQ ID NO: 7770 - RNA, 21 nt, Artificial Sequence
  Synthetic Oligonucleotide
gugaaaagauaaugaucucau

SEQ ID NO: 7771 - RNA, 21 nt, Artificial Sequence
  Synthetic Oligonucleotide
uggugauacuucuuugaaugu

SEQ ID NO: 7772 - RNA, 21 nt, Artificial Sequence
  Synthetic Oligonucleotide
agaagacugacaucauugcca

SEQ ID NO: 7773 - RNA, 21 nt, Artificial Sequence
  Synthetic Oligonucleotide
uggacuuucauccuggaaaua

SEQ ID NO: 7774 - RNA, 21 nt, Artificial Sequence
  Synthetic Oligonucleotide
ucauccuggaaauauauuaac

SEQ ID NO: 7775 - RNA, 21 nt, Artificial Sequence
  Synthetic Oligonucleotide
gagaagacugacaucauugcc

SEQ ID NO: 7776 - RNA, 21 nt, Artificial Sequence
  Synthetic Oligonucleotide
aauuggugauacuucuuugaa

SEQ ID NO: 7777 - RNA, 21 nt, Artificial Sequence
  Synthetic Oligonucleotide
cucauuguuuauuaaccugua

SEQ ID NO: 7778 - RNA, 21 nt, Artificial Sequence
  Synthetic Oligonucleotide
aggugaaaagauaaugaucuc

SEQ ID NO: 7779 - RNA, 21 nt, Artificial Sequence
  Synthetic Oligonucleotide
uuucauccuggaaauauauua

SEQ ID NO: 7780 - RNA, 21 nt, Artificial Sequence
  Synthetic Oligonucleotide
acaaaauagcaaucccuuuua

SEQ ID NO: 7781 - RNA, 21 nt, Artificial Sequence
  Synthetic Oligonucleotide
agauaaugaucucauuguuua

SEQ ID NO: 7782 - RNA, 21 nt, Artificial Sequence
  Synthetic Oligonucleotide
cuuucauccuggaaauauauu

SEQ ID NO: 7783 - RNA, 21 nt, Artificial Sequence
  Synthetic Oligonucleotide
uagcaaucccuuuuauuucau

SEQ ID NO: 7784 - RNA, 21 nt, Artificial Sequence
  Synthetic Oligonucleotide
caaaauagcaaucccuuuuau

SEQ ID NO: 7785 - RNA, 21 nt, Artificial Sequence
  Synthetic Oligonucleotide
ucagcauguauuacuugacaa

SEQ ID NO: 7786 - RNA, 21 nt, Artificial Sequence
  Synthetic Oligonucleotide
guaauuggugauacuucuuug

SEQ ID NO: 7787 - RNA, 21 nt, Artificial Sequence
  Synthetic Oligonucleotide
gggauagcaauaaccugugaa

SEQ ID NO: 7788 - RNA, 21 nt, Artificial Sequence
  Synthetic Oligonucleotide
ucauuguuuauuaaccuguau

SEQ ID NO: 7789 - RNA, 21 nt, Artificial Sequence
  Synthetic Oligonucleotide
cacaacucaggaugaaaaauu

SEQ ID NO: 7790 - RNA, 21 nt, Artificial Sequence
  Synthetic Oligonucleotide
uucauccuggaaauauauuaa

SEQ ID NO: 7791 - RNA, 21 nt, Artificial Sequence
  Synthetic Oligonucleotide
ugggauagcaauaaccuguga

SEQ ID NO: 7792 - RNA, 21 nt, Artificial Sequence
  Synthetic Oligonucleotide
uaauuggugauacuucuuuga

SEQ ID NO: 7793 - RNA, 21 nt, Artificial Sequence
  Synthetic Oligonucleotide
augaaaaauuuugaaaccagu

SEQ ID NO: 7794 - RNA, 21 nt, Artificial Sequence
  Synthetic Oligonucleotide
aauuuguaucaaugauuauga

SEQ ID NO: 7795 - RNA, 21 nt, Artificial Sequence
  Synthetic Oligonucleotide
ggcuaauuuguaucaaugauu

SEQ ID NO: 7796 - RNA, 21 nt, Artificial Sequence
  Synthetic Oligonucleotide
gucugaauauauccaaauguu

SEQ ID NO: 7797 - RNA, 21 nt, Artificial Sequence
  Synthetic Oligonucleotide
aaacagugguucuuaaauugu

SEQ ID NO: 7798 - RNA, 21 nt, Artificial Sequence
  Synthetic Oligonucleotide
ugaucucauuguuuauuaacc

SEQ ID NO: 7799 - RNA, 21 nt, Artificial Sequence
  Synthetic Oligonucleotide
ucucauuguuuauuaaccugu

SEQ ID NO: 7800 - RNA, 21 nt, Artificial Sequence
  Synthetic Oligonucleotide
uuuuuuucagcauguauuacu

SEQ ID NO: 7801 - RNA, 21 nt, Artificial Sequence
  Synthetic Oligonucleotide
aaccaguacuuuaucauuuuc

SEQ ID NO: 7802 - RNA, 21 nt, Artificial Sequence
  Synthetic Oligonucleotide
guaaugccugauucacaacuu

SEQ ID NO: 7803 - RNA, 21 nt, Artificial Sequence
  Synthetic Oligonucleotide
aaaauuuugaaaccaguacuu

SEQ ID NO: 7804 - RNA, 21 nt, Artificial Sequence
  Synthetic Oligonucleotide
auagcaaucccuuuuauuuca

SEQ ID NO: 7805 - RNA, 21 nt, Artificial Sequence
  Synthetic Oligonucleotide
cggcuaauuuguaucaaugau

SEQ ID NO: 7806 - RNA, 21 nt, Artificial Sequence
  Synthetic Oligonucleotide
auccuggaaauauauuaacug

SEQ ID NO: 7807 - RNA, 21 nt, Artificial Sequence
  Synthetic Oligonucleotide
aaaagauaaugaucucauugu

SEQ ID NO: 7808 - RNA, 21 nt, Artificial Sequence
  Synthetic Oligonucleotide
cugaauauauccaaauguuuu

SEQ ID NO: 7809 - RNA, 21 nt, Artificial Sequence
  Synthetic Oligonucleotide
uaauuuguaucaaugauuaug

SEQ ID NO: 7810 - RNA, 21 nt, Artificial Sequence
  Synthetic Oligonucleotide
acugacaucauugccaauugu

SEQ ID NO: 7811 - RNA, 21 nt, Artificial Sequence
  Synthetic Oligonucleotide
aaugauuaugaacaacaugcu

SEQ ID NO: 7812 - RNA, 21 nt, Artificial Sequence
  Synthetic Oligonucleotide
aaaauagcaaucccuuuuauu

SEQ ID NO: 7813 - RNA, 21 nt, Artificial Sequence
  Synthetic Oligonucleotide
ggauagcaauaaccugugaaa

SEQ ID NO: 7814 - RNA, 21 nt, Artificial Sequence
  Synthetic Oligonucleotide
gcuaauuuguaucaaugauua

SEQ ID NO: 7815 - RNA, 21 nt, Artificial Sequence
  Synthetic Oligonucleotide
ugaacaacaugcuaaaucagu

SEQ ID NO: 7816 - RNA, 21 nt, Artificial Sequence
  Synthetic Oligonucleotide
uuauuucauugcuuuugacuu

SEQ ID NO: 7817 - RNA, 21 nt, Artificial Sequence
  Synthetic Oligonucleotide
aaauuguaagcucagguucaa

SEQ ID NO: 7818 - RNA, 21 nt, Artificial Sequence
  Synthetic Oligonucleotide
gacugacaucauugccaauug

SEQ ID NO: 7819 - RNA, 21 nt, Artificial Sequence
  Synthetic Oligonucleotide
aaugaucucauuguuuauuaa

SEQ ID NO: 7820 - RNA, 21 nt, Artificial Sequence
  Synthetic Oligonucleotide
ugauuaugaacaacaugcuaa

SEQ ID NO: 7821 - RNA, 21 nt, Artificial Sequence
  Synthetic Oligonucleotide
aaauggacuuucauccuggaa

SEQ ID NO: 7822 - RNA, 21 nt, Artificial Sequence
  Synthetic Oligonucleotide
aaaguguugguaaugccugau

SEQ ID NO: 7823 - RNA, 21 nt, Artificial Sequence
  Synthetic Oligonucleotide
uuguaucaaugauuaugaaca

SEQ ID NO: 7824 - RNA, 21 nt, Artificial Sequence
  Synthetic Oligonucleotide
caaucccuuuuauuucauugc

SEQ ID NO: 7825 - RNA, 21 nt, Artificial Sequence
  Synthetic Oligonucleotide
cgguaauuggugauacuucuu

SEQ ID NO: 7826 - RNA, 21 nt, Artificial Sequence
  Synthetic Oligonucleotide
ucgacaagacauuggugagga

SEQ ID NO: 7827 - RNA, 21 nt, Artificial Sequence
  Synthetic Oligonucleotide
aauagcaaucccuuuuauuuc

SEQ ID NO: 7828 - RNA, 21 nt, Artificial Sequence
  Synthetic Oligonucleotide
uguugguaaugccugauucac

SEQ ID NO: 7829 - RNA, 21 nt, Artificial Sequence
  Synthetic Oligonucleotide
auauuaacuguuaaaaagaaa

SEQ ID NO: 7830 - RNA, 21 nt, Artificial Sequence
  Synthetic Oligonucleotide
cucaggaugaaaaauuuugaa

SEQ ID NO: 7831 - RNA, 21 nt, Artificial Sequence
  Synthetic Oligonucleotide
cugggauagcaauaaccugug

SEQ ID NO: 7832 - RNA, 21 nt, Artificial Sequence
  Synthetic Oligonucleotide
aaaaauuuugaaaccaguacu

SEQ ID NO: 7833 - RNA, 21 nt, Artificial Sequence
  Synthetic Oligonucleotide
uuggugauacuucuuugaaug

SEQ ID NO: 7834 - RNA, 21 nt, Artificial Sequence
  Synthetic Oligonucleotide
uaucaaugauuaugaacaaca

SEQ ID NO: 7835 - RNA, 21 nt, Artificial Sequence
  Synthetic Oligonucleotide
guaagcucagguucaaagugu

SEQ ID NO: 7836 - RNA, 21 nt, Artificial Sequence
  Synthetic Oligonucleotide
cuaauuuguaucaaugauuau

SEQ ID NO: 7837 - RNA, 21 nt, Artificial Sequence
  Synthetic Oligonucleotide
uauuucauugcuuuugacuuu

SEQ ID NO: 7838 - RNA, 21 nt, Artificial Sequence
  Synthetic Oligonucleotide
ucugaauauauccaaauguuu

SEQ ID NO: 7839 - RNA, 21 nt, Artificial Sequence
  Synthetic Oligonucleotide
augauuaugaacaacaugcua

SEQ ID NO: 7840 - RNA, 21 nt, Artificial Sequence
  Synthetic Oligonucleotide
auauauuaacuguuaaaaaga

SEQ ID NO: 7841 - RNA, 21 nt, Artificial Sequence
  Synthetic Oligonucleotide
guugguaaugccugauucaca

SEQ ID NO: 7842 - RNA, 21 nt, Artificial Sequence
  Synthetic Oligonucleotide
aggaugaaaaauuuugaaacc

SEQ ID NO: 7843 - RNA, 21 nt, Artificial Sequence
  Synthetic Oligonucleotide
uuuugaaaccaguacuuuauc

SEQ ID NO: 7844 - RNA, 21 nt, Artificial Sequence
  Synthetic Oligonucleotide
uuccaaagucuauauaugacu

SEQ ID NO: 7845 - RNA, 21 nt, Artificial Sequence
  Synthetic Oligonucleotide
aacucaggaugaaaaauuuug

SEQ ID NO: 7846 - RNA, 21 nt, Artificial Sequence
  Synthetic Oligonucleotide
uuauuaaccuguauucuguuu

SEQ ID NO: 7847 - RNA, 21 nt, Artificial Sequence
  Synthetic Oligonucleotide
uuucagcauguauuacuugac

SEQ ID NO: 7848 - RNA, 21 nt, Artificial Sequence
  Synthetic Oligonucleotide
cacaauauuuucccaucugua

SEQ ID NO: 7849 - RNA, 21 nt, Artificial Sequence
  Synthetic Oligonucleotide
gucuguaauuccccacuucaa

SEQ ID NO: 7850 - RNA, 21 nt, Artificial Sequence
  Synthetic Oligonucleotide
ucaaaguguugguaaugccug

SEQ ID NO: 7851 - RNA, 21 nt, Artificial Sequence
  Synthetic Oligonucleotide
uaaagugcuguauccuuuagu

SEQ ID NO: 7852 - RNA, 21 nt, Artificial Sequence
  Synthetic Oligonucleotide
gacuuucauccuggaaauaua

SEQ ID NO: 7853 - RNA, 21 nt, Artificial Sequence
  Synthetic Oligonucleotide
cuggaugaugugcguaacaga

SEQ ID NO: 7854 - RNA, 21 nt, Artificial Sequence
  Synthetic Oligonucleotide
ugugaaagucaucgacaagac

SEQ ID NO: 7855 - RNA, 21 nt, Artificial Sequence
  Synthetic Oligonucleotide
acucaggaugaaaaauuuuga

SEQ ID NO: 7856 - RNA, 21 nt, Artificial Sequence
  Synthetic Oligonucleotide
ggaaauauauuaacuguuaaa

SEQ ID NO: 7857 - RNA, 21 nt, Artificial Sequence
  Synthetic Oligonucleotide
uuuuucagcauguauuacuug

SEQ ID NO: 7858 - RNA, 21 nt, Artificial Sequence
  Synthetic Oligonucleotide
uuuucagcauguauuacuuga

SEQ ID NO: 7859 - RNA, 21 nt, Artificial Sequence
  Synthetic Oligonucleotide
ugcacaauauuuucccaucug

SEQ ID NO: 7860 - RNA, 21 nt, Artificial Sequence
  Synthetic Oligonucleotide
caaacacuaaggugaaaagau

SEQ ID NO: 7861 - RNA, 21 nt, Artificial Sequence
  Synthetic Oligonucleotide
agaaugugaaagucaucgaca

SEQ ID NO: 7862 - RNA, 21 nt, Artificial Sequence
  Synthetic Oligonucleotide
ugaaaaauuuugaaaccagua

SEQ ID NO: 7863 - RNA, 21 nt, Artificial Sequence
  Synthetic Oligonucleotide
auggacuuucauccuggaaau

SEQ ID NO: 7864 - RNA, 21 nt, Artificial Sequence
  Synthetic Oligonucleotide
uaaauuguaagcucagguuca

SEQ ID NO: 7865 - RNA, 21 nt, Artificial Sequence
  Synthetic Oligonucleotide
cauccuggaaauauauuaacu

SEQ ID NO: 7866 - RNA, 21 nt, Artificial Sequence
  Synthetic Oligonucleotide
uauauuaacuguuaaaaagaa

SEQ ID NO: 7867 - RNA, 21 nt, Artificial Sequence
  Synthetic Oligonucleotide
aaucccuuuuauuucauugcu

SEQ ID NO: 7868 - RNA, 21 nt, Artificial Sequence
  Synthetic Oligonucleotide
auccaaauguuuuaggaugua

SEQ ID NO: 7869 - RNA, 21 nt, Artificial Sequence
  Synthetic Oligonucleotide
cuguuaaaaagaaaacauuga

SEQ ID NO: 7870 - RNA, 21 nt, Artificial Sequence
  Synthetic Oligonucleotide
agacugacaucauugccaauu

SEQ ID NO: 7871 - RNA, 21 nt, Artificial Sequence
  Synthetic Oligonucleotide
uuugaaaccaguacuuuauca

SEQ ID NO: 7872 - RNA, 21 nt, Artificial Sequence
  Synthetic Oligonucleotide
cacuauugauguucugccaga

SEQ ID NO: 7873 - RNA, 21 nt, Artificial Sequence
  Synthetic Oligonucleotide
gaaauauauuaacuguuaaaa

SEQ ID NO: 7874 - RNA, 21 nt, Artificial Sequence
  Synthetic Oligonucleotide
aucccuuuuauuucauugcuu

SEQ ID NO: 7875 - RNA, 21 nt, Artificial Sequence
  Synthetic Oligonucleotide
aucucauuguuuauuaaccug

SEQ ID NO: 7876 - RNA, 21 nt, Artificial Sequence
  Synthetic Oligonucleotide
uggaugaugugcguaacagau

SEQ ID NO: 7877 - RNA, 21 nt, Artificial Sequence
  Synthetic Oligonucleotide
gaaauggacuuucauccugga

SEQ ID NO: 7878 - RNA, 21 nt, Artificial Sequence
  Synthetic Oligonucleotide
aauuuugaaaccaguacuuua

SEQ ID NO: 7879 - RNA, 21 nt, Artificial Sequence
  Synthetic Oligonucleotide
ccacaacucaggaugaaaaau

SEQ ID NO: 7880 - RNA, 21 nt, Artificial Sequence
  Synthetic Oligonucleotide
agcauguauuacuugacaaag

SEQ ID NO: 7881 - RNA, 21 nt, Artificial Sequence
  Synthetic Oligonucleotide
uuaaauuguaagcucagguuc

SEQ ID NO: 7882 - RNA, 21 nt, Artificial Sequence
  Synthetic Oligonucleotide
uuguuuauuaaccuguauucu

SEQ ID NO: 7883 - RNA, 21 nt, Artificial Sequence
  Synthetic Oligonucleotide
ugaaaccaguacuuuaucauu

SEQ ID NO: 7884 - RNA, 21 nt, Artificial Sequence
  Synthetic Oligonucleotide
cagaaugugaaagucaucgac

SEQ ID NO: 7885 - RNA, 21 nt, Artificial Sequence
  Synthetic Oligonucleotide
guaucaaugauuaugaacaac

SEQ ID NO: 7886 - RNA, 21 nt, Artificial Sequence
  Synthetic Oligonucleotide
gauaaugaucucauuguuuau

SEQ ID NO: 7887 - RNA, 21 nt, Artificial Sequence
  Synthetic Oligonucleotide
cuguauucuguuuacaugucu

SEQ ID NO: 7888 - RNA, 21 nt, Artificial Sequence
  Synthetic Oligonucleotide
caauauuuucccaucuguauu

SEQ ID NO: 7889 - RNA, 21 nt, Artificial Sequence
  Synthetic Oligonucleotide
uuagugucugaauauauccaa

SEQ ID NO: 7890 - RNA, 21 nt, Artificial Sequence
  Synthetic Oligonucleotide
gcacaauauuuucccaucugu

SEQ ID NO: 7891 - RNA, 21 nt, Artificial Sequence
  Synthetic Oligonucleotide
gucguucuuuuccaacaaaau

SEQ ID NO: 7892 - RNA, 21 nt, Artificial Sequence
  Synthetic Oligonucleotide
cugacaucauugccaauuguu

SEQ ID NO: 7893 - RNA, 21 nt, Artificial Sequence
  Synthetic Oligonucleotide
aaguguugguaaugccugauu

SEQ ID NO: 7894 - RNA, 21 nt, Artificial Sequence
  Synthetic Oligonucleotide
gaagacugacaucauugccaa

SEQ ID NO: 7895 - RNA, 21 nt, Artificial Sequence
  Synthetic Oligonucleotide
gaaaagauaaugaucucauug

SEQ ID NO: 7896 - RNA, 21 nt, Artificial Sequence
  Synthetic Oligonucleotide
acaacucaggaugaaaaauuu

SEQ ID NO: 7897 - RNA, 21 nt, Artificial Sequence
  Synthetic Oligonucleotide
cugauaauauugcagcauuuu

SEQ ID NO: 7898 - RNA, 21 nt, Artificial Sequence
  Synthetic Oligonucleotide
gaaaccaguacuuuaucauuu

SEQ ID NO: 7899 - RNA, 21 nt, Artificial Sequence
  Synthetic Oligonucleotide
acaauauuuucccaucuguau

SEQ ID NO: 7900 - RNA, 21 nt, Artificial Sequence
  Synthetic Oligonucleotide
accaguacuuuaucauuuucu

SEQ ID NO: 7901 - RNA, 21 nt, Artificial Sequence
  Synthetic Oligonucleotide
aucaguacuuccaaagucuau

SEQ ID NO: 7902 - RNA, 21 nt, Artificial Sequence
  Synthetic Oligonucleotide
cacuaaggugaaaagauaaug

SEQ ID NO: 7903 - RNA, 21 nt, Artificial Sequence
  Synthetic Oligonucleotide
uaagcucagguucaaaguguu

SEQ ID NO: 7904 - RNA, 21 nt, Artificial Sequence
  Synthetic Oligonucleotide
ggcugagaagacugacaucau

SEQ ID NO: 7905 - RNA, 21 nt, Artificial Sequence
  Synthetic Oligonucleotide
aaggugaaaagauaaugaucu

SEQ ID NO: 7906 - RNA, 21 nt, Artificial Sequence
  Synthetic Oligonucleotide
ccagaaugugaaagucaucga

SEQ ID NO: 7907 - RNA, 21 nt, Artificial Sequence
  Synthetic Oligonucleotide
cagcauguauuacuugacaaa

SEQ ID NO: 7908 - RNA, 21 nt, Artificial Sequence
  Synthetic Oligonucleotide
uucauugcuuuugacuuuuca

SEQ ID NO: 7909 - RNA, 21 nt, Artificial Sequence
  Synthetic Oligonucleotide
acuaaggugaaaagauaauga

SEQ ID NO: 7910 - RNA, 21 nt, Artificial Sequence
  Synthetic Oligonucleotide
ugccugauucacaacuuugag

SEQ ID NO: 7911 - RNA, 21 nt, Artificial Sequence
  Synthetic Oligonucleotide
agcaaucccuuuuauuucauu

SEQ ID NO: 7912 - RNA, 21 nt, Artificial Sequence
  Synthetic Oligonucleotide
uuuauuucauugcuuuugacu

SEQ ID NO: 7913 - RNA, 21 nt, Artificial Sequence
  Synthetic Oligonucleotide
cagucuguaauuccccacuuc

SEQ ID NO: 7914 - RNA, 21 nt, Artificial Sequence
  Synthetic Oligonucleotide
ggugauacuucuuugaaugua

SEQ ID NO: 7915 - RNA, 21 nt, Artificial Sequence
  Synthetic Oligonucleotide
aucaaugauuaugaacaacau

SEQ ID NO: 7916 - RNA, 21 nt, Artificial Sequence
  Synthetic Oligonucleotide
aagugcuguauccuuuaguaa

SEQ ID NO: 7917 - RNA, 21 nt, Artificial Sequence
  Synthetic Oligonucleotide
gugucguucuuuuccaacaaa

SEQ ID NO: 7918 - RNA, 21 nt, Artificial Sequence
  Synthetic Oligonucleotide
caacaaaauagcaaucccuuu

SEQ ID NO: 7919 - RNA, 21 nt, Artificial Sequence
  Synthetic Oligonucleotide
agucuguaauuccccacuuca

SEQ ID NO: 7920 - RNA, 21 nt, Artificial Sequence
  Synthetic Oligonucleotide
ugaaagucaucgacaagacau

SEQ ID NO: 7921 - RNA, 21 nt, Artificial Sequence
  Synthetic Oligonucleotide
uguuuauuaaccuguauucug

SEQ ID NO: 7922 - RNA, 21 nt, Artificial Sequence
  Synthetic Oligonucleotide
guauguuacuucuuagagaga

SEQ ID NO: 7923 - RNA, 21 nt, Artificial Sequence
  Synthetic Oligonucleotide
uauccaaauguuuuaggaugu

SEQ ID NO: 7924 - RNA, 21 nt, Artificial Sequence
  Synthetic Oligonucleotide
ugguucuuaaauuguaagcuc

SEQ ID NO: 7925 - RNA, 21 nt, Artificial Sequence
  Synthetic Oligonucleotide
uccaacaaaauagcaaucccu

SEQ ID NO: 7926 - RNA, 21 nt, Artificial Sequence
  Synthetic Oligonucleotide
augaacaacaugcuaaaucag

SEQ ID NO: 7927 - RNA, 21 nt, Artificial Sequence
  Synthetic Oligonucleotide
gcaaacacuaaggugaaaaga

SEQ ID NO: 7928 - RNA, 21 nt, Artificial Sequence
  Synthetic Oligonucleotide
ccggcuaauuuguaucaauga

SEQ ID NO: 7929 - RNA, 21 nt, Artificial Sequence
  Synthetic Oligonucleotide
aaauagcaaucccuuuuauuu

SEQ ID NO: 7930 - RNA, 21 nt, Artificial Sequence
  Synthetic Oligonucleotide
aauggacuuucauccuggaaa

SEQ ID NO: 7931 - RNA, 21 nt, Artificial Sequence
  Synthetic Oligonucleotide
uggcugauaauauugcagcau

SEQ ID NO: 7932 - RNA, 21 nt, Artificial Sequence
  Synthetic Oligonucleotide
ccaacaaaauagcaaucccuu

SEQ ID NO: 7933 - RNA, 21 nt, Artificial Sequence
  Synthetic Oligonucleotide
aaauguuuuaggauguauguu

SEQ ID NO: 7934 - RNA, 21 nt, Artificial Sequence
  Synthetic Oligonucleotide
uuuagugucugaauauaucca

SEQ ID NO: 7935 - RNA, 21 nt, Artificial Sequence
  Synthetic Oligonucleotide
ucccuuuuauuucauugcuuu

SEQ ID NO: 7936 - RNA, 21 nt, Artificial Sequence
  Synthetic Oligonucleotide
gugucugaauauauccaaaug

SEQ ID NO: 7937 - RNA, 21 nt, Artificial Sequence
  Synthetic Oligonucleotide
gccagaaugugaaagucaucg

SEQ ID NO: 7938 - RNA, 21 nt, Artificial Sequence
  Synthetic Oligonucleotide
gaaaaauuuugaaaccaguac

SEQ ID NO: 7939 - RNA, 21 nt, Artificial Sequence
  Synthetic Oligonucleotide
uuuuuucagcauguauuacuu

SEQ ID NO: 7940 - RNA, 21 nt, Artificial Sequence
  Synthetic Oligonucleotide
ugucugaauauauccaaaugu

SEQ ID NO: 7941 - RNA, 21 nt, Artificial Sequence
  Synthetic Oligonucleotide
ggaugaaaaauuuugaaacca

SEQ ID NO: 7942 - RNA, 21 nt, Artificial Sequence
  Synthetic Oligonucleotide
ucaggaugaaaaauuuugaaa

SEQ ID NO: 7943 - RNA, 21 nt, Artificial Sequence
  Synthetic Oligonucleotide
uccaaagucuauauaugacua

SEQ ID NO: 7944 - RNA, 21 nt, Artificial Sequence
  Synthetic Oligonucleotide
uagugucugaauauauccaaa

SEQ ID NO: 7945 - RNA, 21 nt, Artificial Sequence
  Synthetic Oligonucleotide
caaugauuaugaacaacaugc

SEQ ID NO: 7946 - RNA, 21 nt, Artificial Sequence
  Synthetic Oligonucleotide
uguuaaaaagaaaacauugaa

SEQ ID NO: 7947 - RNA, 21 nt, Artificial Sequence
  Synthetic Oligonucleotide
ggugaaaagauaaugaucuca

SEQ ID NO: 7948 - RNA, 21 nt, Artificial Sequence
  Synthetic Oligonucleotide
ugucguucuuuuccaacaaaa

SEQ ID NO: 7949 - RNA, 21 nt, Artificial Sequence
  Synthetic Oligonucleotide
agugcuguauccuuuaguaaa

SEQ ID NO: 7950 - RNA, 21 nt, Artificial Sequence
  Synthetic Oligonucleotide
aaagugcuguauccuuuagua

SEQ ID NO: 7951 - RNA, 21 nt, Artificial Sequence
  Synthetic Oligonucleotide
caaagucuauauaugacuauu

SEQ ID NO: 7952 - RNA, 21 nt, Artificial Sequence
  Synthetic Oligonucleotide
uucaaaguguugguaaugccu

SEQ ID NO: 7953 - RNA, 21 nt, Artificial Sequence
  Synthetic Oligonucleotide
gcgguaauuggugauacuucu

SEQ ID NO: 7954 - RNA, 21 nt, Artificial Sequence
  Synthetic Oligonucleotide
uccaaauguuuuaggauguau

SEQ ID NO: 7955 - RNA, 21 nt, Artificial Sequence
  Synthetic Oligonucleotide
ugauacuucuuugaauguaga

SEQ ID NO: 7956 - RNA, 21 nt, Artificial Sequence
  Synthetic Oligonucleotide
augaucucauuguuuauuaac

SEQ ID NO: 7957 - RNA, 21 nt, Artificial Sequence
  Synthetic Oligonucleotide
ccaaauguuuuaggauguaug

SEQ ID NO: 7958 - RNA, 21 nt, Artificial Sequence
  Synthetic Oligonucleotide
cugagaagacugacaucauug

SEQ ID NO: 7959 - RNA, 21 nt, Artificial Sequence
  Synthetic Oligonucleotide
uaacuguuaaaaagaaaacau

SEQ ID NO: 7960 - RNA, 21 nt, Artificial Sequence
  Synthetic Oligonucleotide
acuauugauguucugccagaa

SEQ ID NO: 7961 - RNA, 21 nt, Artificial Sequence
  Synthetic Oligonucleotide
aaaacagugguucuuaaauug

SEQ ID NO: 7962 - RNA, 21 nt, Artificial Sequence
  Synthetic Oligonucleotide
acuuucauccuggaaauauau

SEQ ID NO: 7963 - RNA, 21 nt, Artificial Sequence
  Synthetic Oligonucleotide
aacuuuggcugauaauauugc

SEQ ID NO: 7964 - RNA, 21 nt, Artificial Sequence
  Synthetic Oligonucleotide
uuaucauuuucuccugaggaa

SEQ ID NO: 7965 - RNA, 21 nt, Artificial Sequence
  Synthetic Oligonucleotide
aaaucaguacuuccaaagucu

SEQ ID NO: 7966 - RNA, 21 nt, Artificial Sequence
  Synthetic Oligonucleotide
ccuuuuauuucauugcuuuug

SEQ ID NO: 7967 - RNA, 21 nt, Artificial Sequence
  Synthetic Oligonucleotide
agaaauggacuuucauccugg

SEQ ID NO: 7968 - RNA, 21 nt, Artificial Sequence
  Synthetic Oligonucleotide
uacuuccaaagucuauauaug

SEQ ID NO: 7969 - RNA, 21 nt, Artificial Sequence
  Synthetic Oligonucleotide
agggugucguucuuuuccaac

SEQ ID NO: 7970 - RNA, 21 nt, Artificial Sequence
  Synthetic Oligonucleotide
uaaggugaaaagauaaugauc

SEQ ID NO: 7971 - RNA, 21 nt, Artificial Sequence
  Synthetic Oligonucleotide
uguauuacuugacaaagagac

SEQ ID NO: 7972 - RNA, 21 nt, Artificial Sequence
  Synthetic Oligonucleotide
augaugugcguaacagauuca

SEQ ID NO: 7973 - RNA, 21 nt, Artificial Sequence
  Synthetic Oligonucleotide
gaugaaaaauuuugaaaccag

SEQ ID NO: 7974 - RNA, 21 nt, Artificial Sequence
  Synthetic Oligonucleotide
gcugauaauauugcagcauuu

SEQ ID NO: 7975 - RNA, 21 nt, Artificial Sequence
  Synthetic Oligonucleotide
ucuggaugaugugcguaacag

SEQ ID NO: 7976 - RNA, 21 nt, Artificial Sequence
  Synthetic Oligonucleotide
aucgacaagacauuggugagg

SEQ ID NO: 7977 - RNA, 21 nt, Artificial Sequence
  Synthetic Oligonucleotide
caaaguguugguaaugccuga

SEQ ID NO: 7978 - RNA, 21 nt, Artificial Sequence
  Synthetic Oligonucleotide
caaauggcugagaagacugac

SEQ ID NO: 7979 - RNA, 21 nt, Artificial Sequence
  Synthetic Oligonucleotide
augaagaaacuuuggcugaua

SEQ ID NO: 7980 - RNA, 21 nt, Artificial Sequence
  Synthetic Oligonucleotide
ugaaaagauaaugaucucauu

SEQ ID NO: 7981 - RNA, 21 nt, Artificial Sequence
  Synthetic Oligonucleotide
uuuguaucaaugauuaugaac

SEQ ID NO: 7982 - RNA, 21 nt, Artificial Sequence
  Synthetic Oligonucleotide
aagacugacaucauugccaau

SEQ ID NO: 7983 - RNA, 21 nt, Artificial Sequence
  Synthetic Oligonucleotide
guagcaaacacuaaggugaaa

SEQ ID NO: 7984 - RNA, 21 nt, Artificial Sequence
  Synthetic Oligonucleotide
ggugccagaaugugaaaguca

SEQ ID NO: 7985 - RNA, 21 nt, Artificial Sequence
  Synthetic Oligonucleotide
agccacuauugauguucugcc

SEQ ID NO: 7986 - RNA, 21 nt, Artificial Sequence
  Synthetic Oligonucleotide
auuuugaaaccaguacuuuau

SEQ ID NO: 7987 - RNA, 21 nt, Artificial Sequence
  Synthetic Oligonucleotide
ucuguaauuccccacuucaau

SEQ ID NO: 7988 - RNA, 21 nt, Artificial Sequence
  Synthetic Oligonucleotide
gauagcaauaaccugugaaaa

SEQ ID NO: 7989 - RNA, 21 nt, Artificial Sequence
  Synthetic Oligonucleotide
uuaacuguuaaaaagaaaaca

SEQ ID NO: 7990 - RNA, 21 nt, Artificial Sequence
  Synthetic Oligonucleotide
gccacaacucaggaugaaaaa

SEQ ID NO: 7991 - RNA, 21 nt, Artificial Sequence
  Synthetic Oligonucleotide
ucagguucaaaguguugguaa

SEQ ID NO: 7992 - RNA, 21 nt, Artificial Sequence
  Synthetic Oligonucleotide
uuaaccuguauucuguuuaca

SEQ ID NO: 7993 - RNA, 21 nt, Artificial Sequence
  Synthetic Oligonucleotide
caaucacaucuuuagugucug

SEQ ID NO: 7994 - RNA, 21 nt, Artificial Sequence
  Synthetic Oligonucleotide
uuguaagcucagguucaaagu

SEQ ID NO: 7995 - RNA, 21 nt, Artificial Sequence
  Synthetic Oligonucleotide
uucuuugaauguagauuucca

SEQ ID NO: 7996 - RNA, 21 nt, Artificial Sequence
  Synthetic Oligonucleotide
ccggaauguugcugaaacaga

SEQ ID NO: 7997 - RNA, 21 nt, Artificial Sequence
  Synthetic Oligonucleotide
auuaacuguuaaaaagaaaac

SEQ ID NO: 7998 - RNA, 21 nt, Artificial Sequence
  Synthetic Oligonucleotide
aaauauauuaacuguuaaaaa

SEQ ID NO: 7999 - RNA, 21 nt, Artificial Sequence
  Synthetic Oligonucleotide
caaauguuuuaggauguaugu

SEQ ID NO: 8000 - RNA, 21 nt, Artificial Sequence
  Synthetic Oligonucleotide
auuuguaucaaugauuaugaa

SEQ ID NO: 8001 - RNA, 21 nt, Artificial Sequence
  Synthetic Oligonucleotide
uuuaaaacagugguucuuaaa

SEQ ID NO: 8002 - RNA, 21 nt, Artificial Sequence
  Synthetic Oligonucleotide
gaagaaacuuuggcugauaau

SEQ ID NO: 8003 - RNA, 21 nt, Artificial Sequence
  Synthetic Oligonucleotide
ccaagaucugacagugcacaa

SEQ ID NO: 8004 - RNA, 21 nt, Artificial Sequence
  Synthetic Oligonucleotide
cuaaggugaaaagauaaugau

SEQ ID NO: 8005 - RNA, 21 nt, Artificial Sequence
  Synthetic Oligonucleotide
uaauauugcagcauuuuccag

SEQ ID NO: 8006 - RNA, 21 nt, Artificial Sequence
  Synthetic Oligonucleotide
gguagcaaacacuaaggugaa

SEQ ID NO: 8007 - RNA, 21 nt, Artificial Sequence
  Synthetic Oligonucleotide
uugguaaugccugauucacaa

SEQ ID NO: 8008 - RNA, 21 nt, Artificial Sequence
  Synthetic Oligonucleotide
aaugugaaagucaucgacaag

SEQ ID NO: 8009 - RNA, 21 nt, Artificial Sequence
  Synthetic Oligonucleotide
uuaaaacagugguucuuaaau

SEQ ID NO: 8010 - RNA, 21 nt, Artificial Sequence
  Synthetic Oligonucleotide
ccuguauucuguuuacauguc

SEQ ID NO: 8011 - RNA, 21 nt, Artificial Sequence
  Synthetic Oligonucleotide
ugagaagacugacaucauugc

SEQ ID NO: 8012 - RNA, 21 nt, Artificial Sequence
  Synthetic Oligonucleotide
ucuuaaauuguaagcucaggu

SEQ ID NO: 8013 - RNA, 21 nt, Artificial Sequence
  Synthetic Oligonucleotide
uagcaaacacuaaggugaaaa

SEQ ID NO: 8014 - RNA, 21 nt, Artificial Sequence
  Synthetic Oligonucleotide
cucagguucaaaguguuggua

SEQ ID NO: 8015 - RNA, 21 nt, Artificial Sequence
  Synthetic Oligonucleotide
gacaagacauuggugaggaaa

SEQ ID NO: 8016 - RNA, 21 nt, Artificial Sequence
  Synthetic Oligonucleotide
agguagcaaacacuaagguga

SEQ ID NO: 8017 - RNA, 21 nt, Artificial Sequence
  Synthetic Oligonucleotide
uaaaacagugguucuuaaauu

SEQ ID NO: 8018 - RNA, 21 nt, Artificial Sequence
  Synthetic Oligonucleotide
guucaaaguguugguaaugcc

SEQ ID NO: 8019 - RNA, 21 nt, Artificial Sequence
  Synthetic Oligonucleotide
uauuaaccuguauucuguuua

SEQ ID NO: 8020 - RNA, 21 nt, Artificial Sequence
  Synthetic Oligonucleotide
guguugguaaugccugauuca

SEQ ID NO: 8021 - RNA, 21 nt, Artificial Sequence
  Synthetic Oligonucleotide
ucaguacuuccaaagucuaua

SEQ ID NO: 8022 - RNA, 21 nt, Artificial Sequence
  Synthetic Oligonucleotide
caguacuuccaaagucuauau

SEQ ID NO: 8023 - RNA, 21 nt, Artificial Sequence
  Synthetic Oligonucleotide
ucaaugauuaugaacaacaug

SEQ ID NO: 8024 - RNA, 21 nt, Artificial Sequence
  Synthetic Oligonucleotide
uguucaagauguccucgagau

SEQ ID NO: 8025 - RNA, 21 nt, Artificial Sequence
  Synthetic Oligonucleotide
cuuuaaaacagugguucuuaa

SEQ ID NO: 8026 - RNA, 21 nt, Artificial Sequence
  Synthetic Oligonucleotide
gaucucauuguuuauuaaccu

SEQ ID NO: 8027 - RNA, 21 nt, Artificial Sequence
  Synthetic Oligonucleotide
aguguugguaaugccugauuc

SEQ ID NO: 8028 - RNA, 21 nt, Artificial Sequence
  Synthetic Oligonucleotide
acaacaugcuaaaucaguacu

SEQ ID NO: 8029 - RNA, 21 nt, Artificial Sequence
  Synthetic Oligonucleotide
uucuuaaauuguaagcucagg

SEQ ID NO: 8030 - RNA, 21 nt, Artificial Sequence
  Synthetic Oligonucleotide
uucguuggcugcaacuguaua

SEQ ID NO: 8031 - RNA, 21 nt, Artificial Sequence
  Synthetic Oligonucleotide
uaaaucaguacuuccaaaguc

SEQ ID NO: 8032 - RNA, 21 nt, Artificial Sequence
  Synthetic Oligonucleotide
acaagacauuggugaggaaaa

SEQ ID NO: 8033 - RNA, 21 nt, Artificial Sequence
  Synthetic Oligonucleotide
gcauguauuacuugacaaaga

SEQ ID NO: 8034 - RNA, 21 nt, Artificial Sequence
  Synthetic Oligonucleotide
gugauacuucuuugaauguag

SEQ ID NO: 8035 - RNA, 21 nt, Artificial Sequence
  Synthetic Oligonucleotide
caagaucugacagugcacaau

SEQ ID NO: 8036 - RNA, 21 nt, Artificial Sequence
  Synthetic Oligonucleotide
acaucuuuagugucugaauau

SEQ ID NO: 8037 - RNA, 21 nt, Artificial Sequence
  Synthetic Oligonucleotide
agcaaacacuaaggugaaaag

SEQ ID NO: 8038 - RNA, 21 nt, Artificial Sequence
  Synthetic Oligonucleotide
auagcaauaaccugugaaaau

SEQ ID NO: 8039 - RNA, 21 nt, Artificial Sequence
  Synthetic Oligonucleotide
aauauauuaacuguuaaaaag

SEQ ID NO: 8040 - RNA, 21 nt, Artificial Sequence
  Synthetic Oligonucleotide
ugaugugcguaacagauucaa

SEQ ID NO: 8041 - RNA, 21 nt, Artificial Sequence
  Synthetic Oligonucleotide
aaucaguacuuccaaagucua

SEQ ID NO: 8042 - RNA, 21 nt, Artificial Sequence
  Synthetic Oligonucleotide
gguaauuggugauacuucuuu

SEQ ID NO: 8043 - RNA, 21 nt, Artificial Sequence
  Synthetic Oligonucleotide
uuccaacaaaauagcaauccc

SEQ ID NO: 8044 - RNA, 21 nt, Artificial Sequence
  Synthetic Oligonucleotide
uguaagcucagguucaaagug

SEQ ID NO: 8045 - RNA, 21 nt, Artificial Sequence
  Synthetic Oligonucleotide
aucugacagugcacaauauuu

SEQ ID NO: 8046 - RNA, 21 nt, Artificial Sequence
  Synthetic Oligonucleotide
uugcagcauuuuccagaugga

SEQ ID NO: 8047 - RNA, 21 nt, Artificial Sequence
  Synthetic Oligonucleotide
gugguucuuaaauuguaagcu

SEQ ID NO: 8048 - RNA, 21 nt, Artificial Sequence
  Synthetic Oligonucleotide
ugaugaagaaacuuuggcuga

SEQ ID NO: 8049 - RNA, 21 nt, Artificial Sequence
  Synthetic Oligonucleotide
aaacacuaaggugaaaagaua

SEQ ID NO: 8050 - RNA, 21 nt, Artificial Sequence
  Synthetic Oligonucleotide
auuguuuauuaaccuguauuc

SEQ ID NO: 8051 - RNA, 21 nt, Artificial Sequence
  Synthetic Oligonucleotide
cgccacaacucaggaugaaaa

SEQ ID NO: 8052 - RNA, 21 nt, Artificial Sequence
  Synthetic Oligonucleotide
agaaacuuuggcugauaauau

SEQ ID NO: 8053 - RNA, 21 nt, Artificial Sequence
  Synthetic Oligonucleotide
gugcacaauauuuucccaucu

SEQ ID NO: 8054 - RNA, 21 nt, Artificial Sequence
  Synthetic Oligonucleotide
gugaaagucaucgacaagaca

SEQ ID NO: 8055 - RNA, 21 nt, Artificial Sequence
  Synthetic Oligonucleotide
gauuaugaacaacaugcuaaa

SEQ ID NO: 8056 - RNA, 21 nt, Artificial Sequence
  Synthetic Oligonucleotide
accuguauucuguuuacaugu

SEQ ID NO: 8057 - RNA, 21 nt, Artificial Sequence
  Synthetic Oligonucleotide
ugauaauauugcagcauuuuc

SEQ ID NO: 8058 - RNA, 21 nt, Artificial Sequence
  Synthetic Oligonucleotide
auauuuucccaucuguauuau

SEQ ID NO: 8059 - RNA, 21 nt, Artificial Sequence
  Synthetic Oligonucleotide
uguauguuacuucuuagagag

SEQ ID NO: 8060 - RNA, 21 nt, Artificial Sequence
  Synthetic Oligonucleotide
ucaucgacaagacauugguga

SEQ ID NO: 8061 - RNA, 21 nt, Artificial Sequence
  Synthetic Oligonucleotide
agcucagguucaaaguguugg

SEQ ID NO: 8062 - RNA, 21 nt, Artificial Sequence
  Synthetic Oligonucleotide
auguauuacuugacaaagaga

SEQ ID NO: 8063 - RNA, 21 nt, Artificial Sequence
  Synthetic Oligonucleotide
cauguauuacuugacaaagag

SEQ ID NO: 8064 - RNA, 21 nt, Artificial Sequence
  Synthetic Oligonucleotide
ggugucguucuuuuccaacaa

SEQ ID NO: 8065 - RNA, 21 nt, Artificial Sequence
  Synthetic Oligonucleotide
ccaaagucuauauaugacuau

SEQ ID NO: 8066 - RNA, 21 nt, Artificial Sequence
  Synthetic Oligonucleotide
gagguagcaaacacuaaggug

SEQ ID NO: 8067 - RNA, 21 nt, Artificial Sequence
  Synthetic Oligonucleotide
auaucaaauggcugagaagac

SEQ ID NO: 8068 - RNA, 21 nt, Artificial Sequence
  Synthetic Oligonucleotide
aaaccaguacuuuaucauuuu

SEQ ID NO: 8069 - RNA, 21 nt, Artificial Sequence
  Synthetic Oligonucleotide
gguaaugccugauucacaacu

SEQ ID NO: 8070 - RNA, 21 nt, Artificial Sequence
  Synthetic Oligonucleotide
ccacuauugauguucugccag

SEQ ID NO: 8071 - RNA, 21 nt, Artificial Sequence
  Synthetic Oligonucleotide
guuuauuaaccuguauucugu

SEQ ID NO: 8072 - RNA, 21 nt, Artificial Sequence
  Synthetic Oligonucleotide
cuauugauguucugccagaaa

SEQ ID NO: 8073 - RNA, 21 nt, Artificial Sequence
  Synthetic Oligonucleotide
caggaugaaaaauuuugaaac

SEQ ID NO: 8074 - RNA, 21 nt, Artificial Sequence
  Synthetic Oligonucleotide
uaucauuuucuccugaggaaa

SEQ ID NO: 8075 - RNA, 21 nt, Artificial Sequence
  Synthetic Oligonucleotide
ugguaaugccugauucacaac

SEQ ID NO: 8076 - RNA, 21 nt, Artificial Sequence
  Synthetic Oligonucleotide
aaccuguauucuguuuacaug

SEQ ID NO: 8077 - RNA, 21 nt, Artificial Sequence
  Synthetic Oligonucleotide
aagucaucgacaagacauugg

SEQ ID NO: 8078 - RNA, 21 nt, Artificial Sequence
  Synthetic Oligonucleotide
ugaagaaacuuuggcugauaa

SEQ ID NO: 8079 - RNA, 21 nt, Artificial Sequence
  Synthetic Oligonucleotide
acagugguucuuaaauuguaa

SEQ ID NO: 8080 - RNA, 21 nt, Artificial Sequence
  Synthetic Oligonucleotide
aauauauccaaauguuuuagg

SEQ ID NO: 8081 - RNA, 21 nt, Artificial Sequence
  Synthetic Oligonucleotide
caagacauuggugaggaaaaa

SEQ ID NO: 8082 - RNA, 21 nt, Artificial Sequence
  Synthetic Oligonucleotide
ucugacagugcacaauauuuu

SEQ ID NO: 8083 - RNA, 21 nt, Artificial Sequence
  Synthetic Oligonucleotide
gugccagaaugugaaagucau

SEQ ID NO: 8084 - RNA, 21 nt, Artificial Sequence
  Synthetic Oligonucleotide
ugaauguagauuuccaaucac

SEQ ID NO: 8085 - RNA, 21 nt, Artificial Sequence
  Synthetic Oligonucleotide
acuguuaaaaagaaaacauug

SEQ ID NO: 8086 - RNA, 21 nt, Artificial Sequence
  Synthetic Oligonucleotide
uaugaacaacaugcuaaauca

SEQ ID NO: 8087 - RNA, 21 nt, Artificial Sequence
  Synthetic Oligonucleotide
uguaucaaugauuaugaacaa

SEQ ID NO: 8088 - RNA, 21 nt, Artificial Sequence
  Synthetic Oligonucleotide
guauucuguuuacaugucuuu

SEQ ID NO: 8089 - RNA, 21 nt, Artificial Sequence
  Synthetic Oligonucleotide
caacucaggaugaaaaauuuu

SEQ ID NO: 8090 - RNA, 21 nt, Artificial Sequence
  Synthetic Oligonucleotide
auauccaaauguuuuaggaug

SEQ ID NO: 8091 - RNA, 21 nt, Artificial Sequence
  Synthetic Oligonucleotide
ggcgguaauuggugauacuuc

SEQ ID NO: 8092 - RNA, 21 nt, Artificial Sequence
  Synthetic Oligonucleotide
gaugaagaaacuuuggcugau

SEQ ID NO: 8093 - RNA, 21 nt, Artificial Sequence
  Synthetic Oligonucleotide
uuucauugcuuuugacuuuuc

SEQ ID NO: 8094 - RNA, 21 nt, Artificial Sequence
  Synthetic Oligonucleotide
agugucugaauauauccaaau

SEQ ID NO: 8095 - RNA, 21 nt, Artificial Sequence
  Synthetic Oligonucleotide
cauuguuuauuaaccuguauu

SEQ ID NO: 8096 - RNA, 21 nt, Artificial Sequence
  Synthetic Oligonucleotide
auauauccaaauguuuuagga

SEQ ID NO: 8097 - RNA, 21 nt, Artificial Sequence
  Synthetic Oligonucleotide
gacagugcacaauauuuuccc

SEQ ID NO: 8098 - RNA, 21 nt, Artificial Sequence
  Synthetic Oligonucleotide
uaaccuguauucuguuuacau

SEQ ID NO: 8099 - RNA, 21 nt, Artificial Sequence
  Synthetic Oligonucleotide
uaaugccugauucacaacuuu

SEQ ID NO: 8100 - RNA, 21 nt, Artificial Sequence
  Synthetic Oligonucleotide
uauugauguucugccagaaau

SEQ ID NO: 8101 - RNA, 21 nt, Artificial Sequence
  Synthetic Oligonucleotide
uugaauguagauuuccaauca

SEQ ID NO: 8102 - RNA, 21 nt, Artificial Sequence
  Synthetic Oligonucleotide
cccuuuuauuucauugcuuuu

SEQ ID NO: 8103 - RNA, 21 nt, Artificial Sequence
  Synthetic Oligonucleotide
ugccagaaugugaaagucauc

SEQ ID NO: 8104 - RNA, 21 nt, Artificial Sequence
  Synthetic Oligonucleotide
gaaugugaaagucaucgacaa

SEQ ID NO: 8105 - RNA, 21 nt, Artificial Sequence
  Synthetic Oligonucleotide
ggaugaugugcguaacagauu

SEQ ID NO: 8106 - RNA, 21 nt, Artificial Sequence
  Synthetic Oligonucleotide
aagcucagguucaaaguguug

SEQ ID NO: 8107 - RNA, 21 nt, Artificial Sequence
  Synthetic Oligonucleotide
uauucuguuuacaugucuuua

SEQ ID NO: 8108 - RNA, 21 nt, Artificial Sequence
  Synthetic Oligonucleotide
cgacaagacauuggugaggaa

SEQ ID NO: 8109 - RNA, 21 nt, Artificial Sequence
  Synthetic Oligonucleotide
uaguaaaauuggagguagcaa

SEQ ID NO: 8110 - RNA, 21 nt, Artificial Sequence
  Synthetic Oligonucleotide
aguacuuccaaagucuauaua

SEQ ID NO: 8111 - RNA, 21 nt, Artificial Sequence
  Synthetic Oligonucleotide
gaauguagauuuccaaucaca

SEQ ID NO: 8112 - RNA, 21 nt, Artificial Sequence
  Synthetic Oligonucleotide
uccaagaucugacagugcaca

SEQ ID NO: 8113 - RNA, 21 nt, Artificial Sequence
  Synthetic Oligonucleotide
auacuucuuugaauguagauu

SEQ ID NO: 8114 - RNA, 21 nt, Artificial Sequence
  Synthetic Oligonucleotide
ggcugauaauauugcagcauu

SEQ ID NO: 8115 - RNA, 21 nt, Artificial Sequence
  Synthetic Oligonucleotide
augcuaaaucaguacuuccaa

SEQ ID NO: 8116 - RNA, 21 nt, Artificial Sequence
  Synthetic Oligonucleotide
uagagagaaauaaagcauuuu

SEQ ID NO: 8117 - RNA, 21 nt, Artificial Sequence
  Synthetic Oligonucleotide
gaauauauccaaauguuuuag

SEQ ID NO: 8118 - RNA, 21 nt, Artificial Sequence
  Synthetic Oligonucleotide
uuuuauuucauugcuuuugac

SEQ ID NO: 8119 - RNA, 21 nt, Artificial Sequence
  Synthetic Oligonucleotide
acagugcacaauauuuuccca

SEQ ID NO: 8120 - RNA, 21 nt, Artificial Sequence
  Synthetic Oligonucleotide
aucacaucuuuagugucugaa

SEQ ID NO: 8121 - RNA, 21 nt, Artificial Sequence
  Synthetic Oligonucleotide
auguauguuacuucuuagaga

SEQ ID NO: 8122 - RNA, 21 nt, Artificial Sequence
  Synthetic Oligonucleotide
cuaggaaccuuuuagaaagaa

SEQ ID NO: 8123 - RNA, 21 nt, Artificial Sequence
  Synthetic Oligonucleotide
guguucaagauguccucgaga

SEQ ID NO: 8124 - RNA, 21 nt, Artificial Sequence
  Synthetic Oligonucleotide
cccggcuaauuuguaucaaug

SEQ ID NO: 8125 - RNA, 21 nt, Artificial Sequence
  Synthetic Oligonucleotide
aaagggugucguucuuuucca

SEQ ID NO: 8126 - RNA, 21 nt, Artificial Sequence
  Synthetic Oligonucleotide
aaccuuuuagaaagaaaugga

SEQ ID NO: 8127 - RNA, 21 nt, Artificial Sequence
  Synthetic Oligonucleotide
ucauugcuuuugacuuuucaa

SEQ ID NO: 8128 - RNA, 21 nt, Artificial Sequence
  Synthetic Oligonucleotide
aucaaauggcugagaagacug

SEQ ID NO: 8129 - RNA, 21 nt, Artificial Sequence
  Synthetic Oligonucleotide
ucguucuuuuccaacaaaaua

SEQ ID NO: 8130 - RNA, 21 nt, Artificial Sequence
  Synthetic Oligonucleotide
gggugucguucuuuuccaaca

SEQ ID NO: 8131 - RNA, 21 nt, Artificial Sequence
  Synthetic Oligonucleotide
uuuauuaaccuguauucuguu

SEQ ID NO: 8132 - RNA, 21 nt, Artificial Sequence
  Synthetic Oligonucleotide
cuuaaauuguaagcucagguu

SEQ ID NO: 8133 - RNA, 21 nt, Artificial Sequence
  Synthetic Oligonucleotide
uggcugagaagacugacauca

SEQ ID NO: 8134 - RNA, 21 nt, Artificial Sequence
  Synthetic Oligonucleotide
uccggaauguugcugaaacag

SEQ ID NO: 8135 - RNA, 21 nt, Artificial Sequence
  Synthetic Oligonucleotide
ugaauauauccaaauguuuua

SEQ ID NO: 8136 - RNA, 21 nt, Artificial Sequence
  Synthetic Oligonucleotide
cacagucuguaauuccccacu

SEQ ID NO: 8137 - RNA, 21 nt, Artificial Sequence
  Synthetic Oligonucleotide
uuggcugcaacuguauaucua

SEQ ID NO: 8138 - RNA, 21 nt, Artificial Sequence
  Synthetic Oligonucleotide
uauuaacuguuaaaaagaaaa

SEQ ID NO: 8139 - RNA, 21 nt, Artificial Sequence
  Synthetic Oligonucleotide
augaugaagaaacuuuggcug

SEQ ID NO: 8140 - RNA, 21 nt, Artificial Sequence
  Synthetic Oligonucleotide
aacaacaugcuaaaucaguac

SEQ ID NO: 8141 - RNA, 21 nt, Artificial Sequence
  Synthetic Oligonucleotide
auuggugauacuucuuugaau

SEQ ID NO: 8142 - RNA, 21 nt, Artificial Sequence
  Synthetic Oligonucleotide
ugauucacaacuuugagaagg

SEQ ID NO: 8143 - RNA, 21 nt, Artificial Sequence
  Synthetic Oligonucleotide
auuucauugcuuuugacuuuu

SEQ ID NO: 8144 - RNA, 21 nt, Artificial Sequence
  Synthetic Oligonucleotide
cauuuuccagauggaagcugu

SEQ ID NO: 8145 - RNA, 21 nt, Artificial Sequence
  Synthetic Oligonucleotide
uguauucuguuuacaugucuu

SEQ ID NO: 8146 - RNA, 21 nt, Artificial Sequence
  Synthetic Oligonucleotide
uacuugacaaagagacacugu

SEQ ID NO: 8147 - RNA, 21 nt, Artificial Sequence
  Synthetic Oligonucleotide
agguucaaaguguugguaaug

SEQ ID NO: 8148 - RNA, 21 nt, Artificial Sequence
  Synthetic Oligonucleotide
aacuguuaaaaagaaaacauu

SEQ ID NO: 8149 - RNA, 21 nt, Artificial Sequence
  Synthetic Oligonucleotide
caauacaaagggugucguucu

SEQ ID NO: 8150 - RNA, 21 nt, Artificial Sequence
  Synthetic Oligonucleotide
uacuuuaucauuuucuccuga

SEQ ID NO: 8151 - RNA, 21 nt, Artificial Sequence
  Synthetic Oligonucleotide
ucuuuaaaacagugguucuua

SEQ ID NO: 8152 - RNA, 21 nt, Artificial Sequence
  Synthetic Oligonucleotide
uccaaucacaucuuuaguguc

SEQ ID NO: 8153 - RNA, 21 nt, Artificial Sequence
  Synthetic Oligonucleotide
cuuccaaagucuauauaugac

SEQ ID NO: 8154 - RNA, 21 nt, Artificial Sequence
  Synthetic Oligonucleotide
uuuaucauuuucuccugagga

SEQ ID NO: 8155 - RNA, 21 nt, Artificial Sequence
  Synthetic Oligonucleotide
uauguuacuucuuagagagaa

SEQ ID NO: 8156 - RNA, 21 nt, Artificial Sequence
  Synthetic Oligonucleotide
caguacuuuaucauuuucucc

SEQ ID NO: 8157 - RNA, 21 nt, Artificial Sequence
  Synthetic Oligonucleotide
gaucugacagugcacaauauu

SEQ ID NO: 8158 - RNA, 21 nt, Artificial Sequence
  Synthetic Oligonucleotide
ucaagauguccucgagauacu

SEQ ID NO: 8159 - RNA, 21 nt, Artificial Sequence
  Synthetic Oligonucleotide
uuacuugacaaagagacacug

SEQ ID NO: 8160 - RNA, 21 nt, Artificial Sequence
  Synthetic Oligonucleotide
aaugccugauucacaacuuug

SEQ ID NO: 8161 - RNA, 21 nt, Artificial Sequence
  Synthetic Oligonucleotide
auuaugaacaacaugcuaaau

SEQ ID NO: 8162 - RNA, 21 nt, Artificial Sequence
  Synthetic Oligonucleotide
aauuguaagcucagguucaaa

SEQ ID NO: 8163 - RNA, 21 nt, Artificial Sequence
  Synthetic Oligonucleotide
aagaaauggacuuucauccug

SEQ ID NO: 8164 - RNA, 21 nt, Artificial Sequence
  Synthetic Oligonucleotide
cuaaagugcuguauccuuuag

SEQ ID NO: 8165 - RNA, 21 nt, Artificial Sequence
  Synthetic Oligonucleotide
ugagugggugccagaauguga

SEQ ID NO: 8166 - RNA, 21 nt, Artificial Sequence
  Synthetic Oligonucleotide
aggauguauguuacuucuuag

SEQ ID NO: 8167 - RNA, 21 nt, Artificial Sequence
  Synthetic Oligonucleotide
augugaaagucaucgacaaga

SEQ ID NO: 8168 - RNA, 21 nt, Artificial Sequence
  Synthetic Oligonucleotide
gaagauaucaaauggcugaga

SEQ ID NO: 8169 - RNA, 21 nt, Artificial Sequence
  Synthetic Oligonucleotide
auucuguuuacaugucuuuaa

SEQ ID NO: 8170 - RNA, 21 nt, Artificial Sequence
  Synthetic Oligonucleotide
aacacuaaggugaaaagauaa

SEQ ID NO: 8171 - RNA, 21 nt, Artificial Sequence
  Synthetic Oligonucleotide
aagucuauauaugacuauuac

SEQ ID NO: 8172 - RNA, 21 nt, Artificial Sequence
  Synthetic Oligonucleotide
guacuuuaucauuuucuccug

SEQ ID NO: 8173 - RNA, 21 nt, Artificial Sequence
  Synthetic Oligonucleotide
ugcagcauuuuccagauggaa

SEQ ID NO: 8174 - RNA, 21 nt, Artificial Sequence
  Synthetic Oligonucleotide
caucuuuagugucugaauaua

SEQ ID NO: 8175 - RNA, 21 nt, Artificial Sequence
  Synthetic Oligonucleotide
gggugccagaaugugaaaguc

SEQ ID NO: 8176 - RNA, 21 nt, Artificial Sequence
  Synthetic Oligonucleotide
gauguauguuacuucuuagag

SEQ ID NO: 8177 - RNA, 21 nt, Artificial Sequence
  Synthetic Oligonucleotide
aaauggcugagaagacugaca

SEQ ID NO: 8178 - RNA, 21 nt, Artificial Sequence
  Synthetic Oligonucleotide
cacaucuuuagugucugaaua

SEQ ID NO: 8179 - RNA, 21 nt, Artificial Sequence
  Synthetic Oligonucleotide
aagaaacuuuggcugauaaua

SEQ ID NO: 8180 - RNA, 21 nt, Artificial Sequence
  Synthetic Oligonucleotide
caagauguccucgagauacua

SEQ ID NO: 8181 - RNA, 21 nt, Artificial Sequence
  Synthetic Oligonucleotide
gucaucgacaagacauuggug

SEQ ID NO: 8182 - RNA, 21 nt, Artificial Sequence
  Synthetic Oligonucleotide
aagaucugacagugcacaaua

SEQ ID NO: 8183 - RNA, 21 nt, Artificial Sequence
  Synthetic Oligonucleotide
augccugauucacaacuuuga

SEQ ID NO: 8184 - RNA, 21 nt, Artificial Sequence
  Synthetic Oligonucleotide
ugcugcauauguggcuaaagc

SEQ ID NO: 8185 - RNA, 21 nt, Artificial Sequence
  Synthetic Oligonucleotide
uaggaaccuuuuagaaagaaa

SEQ ID NO: 8186 - RNA, 21 nt, Artificial Sequence
  Synthetic Oligonucleotide
gguucaaaguguugguaaugc

SEQ ID NO: 8187 - RNA, 21 nt, Artificial Sequence
  Synthetic Oligonucleotide
gugcuguauccuuuaguaaaa

SEQ ID NO: 8188 - RNA, 21 nt, Artificial Sequence
  Synthetic Oligonucleotide
ccgccacaacucaggaugaaa

SEQ ID NO: 8189 - RNA, 21 nt, Artificial Sequence
  Synthetic Oligonucleotide
ucacaucuuuagugucugaau

SEQ ID NO: 8190 - RNA, 21 nt, Artificial Sequence
  Synthetic Oligonucleotide
cagguucaaaguguugguaau

SEQ ID NO: 8191 - RNA, 21 nt, Artificial Sequence
  Synthetic Oligonucleotide
ucauuuucuccugaggaaaau

SEQ ID NO: 8192 - RNA, 21 nt, Artificial Sequence
  Synthetic Oligonucleotide
ucguuggcugcaacuguauau

SEQ ID NO: 8193 - RNA, 21 nt, Artificial Sequence
  Synthetic Oligonucleotide
cacuucguuggcugcaacugu

SEQ ID NO: 8194 - RNA, 21 nt, Artificial Sequence
  Synthetic Oligonucleotide
cuuuuauuucauugcuuuuga

SEQ ID NO: 8195 - RNA, 21 nt, Artificial Sequence
  Synthetic Oligonucleotide
aauauuuucccaucuguauua

SEQ ID NO: 8196 - RNA, 21 nt, Artificial Sequence
  Synthetic Oligonucleotide
ugacaucauugccaauuguug

SEQ ID NO: 8197 - RNA, 21 nt, Artificial Sequence
  Synthetic Oligonucleotide
gagaaauaaagcauuuuuggg

SEQ ID NO: 8198 - RNA, 21 nt, Artificial Sequence
  Synthetic Oligonucleotide
acagucuguaauuccccacuu

SEQ ID NO: 8199 - RNA, 21 nt, Artificial Sequence
  Synthetic Oligonucleotide
gcugagaagacugacaucauu

SEQ ID NO: 8200 - RNA, 21 nt, Artificial Sequence
  Synthetic Oligonucleotide
uucuuuuccaacaaaauagca

SEQ ID NO: 8201 - RNA, 21 nt, Artificial Sequence
  Synthetic Oligonucleotide
gccacuauugauguucugcca

SEQ ID NO: 8202 - RNA, 21 nt, Artificial Sequence
  Synthetic Oligonucleotide
gaacaacaugcuaaaucagua

SEQ ID NO: 8203 - RNA, 21 nt, Artificial Sequence
  Synthetic Oligonucleotide
uccuuuaguaaaauuggaggu

SEQ ID NO: 8204 - RNA, 21 nt, Artificial Sequence
  Synthetic Oligonucleotide
ugcuuuugacuuuucaauggg

SEQ ID NO: 8205 - RNA, 21 nt, Artificial Sequence
  Synthetic Oligonucleotide
accuuuuagaaagaaauggac

SEQ ID NO: 8206 - RNA, 21 nt, Artificial Sequence
  Synthetic Oligonucleotide
ccaaucacaucuuuagugucu

SEQ ID NO: 8207 - RNA, 21 nt, Artificial Sequence
  Synthetic Oligonucleotide
aauauugcagcauuuuccaga

SEQ ID NO: 8208 - RNA, 21 nt, Artificial Sequence
  Synthetic Oligonucleotide
guuggcugcaacuguauaucu

SEQ ID NO: 8209 - RNA, 21 nt, Artificial Sequence
  Synthetic Oligonucleotide
uauuacuugacaaagagacac

SEQ ID NO: 8210 - RNA, 21 nt, Artificial Sequence
  Synthetic Oligonucleotide
ccaucuaucagcugggaagau

SEQ ID NO: 8211 - RNA, 21 nt, Artificial Sequence
  Synthetic Oligonucleotide
cuuuagugucugaauauaucc

SEQ ID NO: 8212 - RNA, 21 nt, Artificial Sequence
  Synthetic Oligonucleotide
aaucacaucuuuagugucuga

SEQ ID NO: 8213 - RNA, 21 nt, Artificial Sequence
  Synthetic Oligonucleotide
gcaaucccuuuuauuucauug

SEQ ID NO: 8214 - RNA, 21 nt, Artificial Sequence
  Synthetic Oligonucleotide
aucuuuagugucugaauauau

SEQ ID NO: 8215 - RNA, 21 nt, Artificial Sequence
  Synthetic Oligonucleotide
auuaaccuguauucuguuuac

SEQ ID NO: 8216 - RNA, 21 nt, Artificial Sequence
  Synthetic Oligonucleotide
gacaucauugccaauuguugc

SEQ ID NO: 8217 - RNA, 21 nt, Artificial Sequence
  Synthetic Oligonucleotide
caaagggugucguucuuuucc

SEQ ID NO: 8218 - RNA, 21 nt, Artificial Sequence
  Synthetic Oligonucleotide
uguccucgagauacuaaagga

SEQ ID NO: 8219 - RNA, 21 nt, Artificial Sequence
  Synthetic Oligonucleotide
uguuacuucuuagagagaaau

SEQ ID NO: 8220 - RNA, 21 nt, Artificial Sequence
  Synthetic Oligonucleotide
auacaaagggugucguucuuu

SEQ ID NO: 8221 - RNA, 21 nt, Artificial Sequence
  Synthetic Oligonucleotide
uuaggauguauguuacuucuu

SEQ ID NO: 8222 - RNA, 21 nt, Artificial Sequence
  Synthetic Oligonucleotide
uuggcugauaauauugcagca

SEQ ID NO: 8223 - RNA, 21 nt, Artificial Sequence
  Synthetic Oligonucleotide
uuccaagaucugacagugcac

SEQ ID NO: 8224 - RNA, 21 nt, Artificial Sequence
  Synthetic Oligonucleotide
ucaaauggcugagaagacuga

SEQ ID NO: 8225 - RNA, 21 nt, Artificial Sequence
  Synthetic Oligonucleotide
acuuccaaagucuauauauga

SEQ ID NO: 8226 - RNA, 21 nt, Artificial Sequence
  Synthetic Oligonucleotide
uuagagagaaauaaagcauuu

SEQ ID NO: 8227 - RNA, 21 nt, Artificial Sequence
  Synthetic Oligonucleotide
guuacuucuuagagagaaaua

SEQ ID NO: 8228 - RNA, 21 nt, Artificial Sequence
  Synthetic Oligonucleotide
ugggugccagaaugugaaagu

SEQ ID NO: 8229 - RNA, 21 nt, Artificial Sequence
  Synthetic Oligonucleotide
gcucagguucaaaguguuggu

SEQ ID NO: 8230 - RNA, 21 nt, Artificial Sequence
  Synthetic Oligonucleotide
agaagguagcacuggagagaa

SEQ ID NO: 8231 - RNA, 21 nt, Artificial Sequence
  Synthetic Oligonucleotide
acacuaaggugaaaagauaau

SEQ ID NO: 8232 - RNA, 21 nt, Artificial Sequence
  Synthetic Oligonucleotide
auaauauugcagcauuuucca

SEQ ID NO: 8233 - RNA, 21 nt, Artificial Sequence
  Synthetic Oligonucleotide
aaagaaauggacuuucauccu

SEQ ID NO: 8234 - RNA, 21 nt, Artificial Sequence
  Synthetic Oligonucleotide
ucuuagagagaaauaaagcau

SEQ ID NO: 8235 - RNA, 21 nt, Artificial Sequence
  Synthetic Oligonucleotide
agugguucuuaaauuguaagc

SEQ ID NO: 8236 - RNA, 21 nt, Artificial Sequence
  Synthetic Oligonucleotide
cuuuaucauuuucuccugagg

SEQ ID NO: 8237 - RNA, 21 nt, Artificial Sequence
  Synthetic Oligonucleotide
gauacuucuuugaauguagau

SEQ ID NO: 8238 - RNA, 21 nt, Artificial Sequence
  Synthetic Oligonucleotide
guucuuaaauuguaagcucag

SEQ ID NO: 8239 - RNA, 21 nt, Artificial Sequence
  Synthetic Oligonucleotide
acaugcuaaaucaguacuucc

SEQ ID NO: 8240 - RNA, 21 nt, Artificial Sequence
  Synthetic Oligonucleotide
ggaauguugcugaaacagauc

SEQ ID NO: 8241 - RNA, 21 nt, Artificial Sequence
  Synthetic Oligonucleotide
auuguaagcucagguucaaag

SEQ ID NO: 8242 - RNA, 21 nt, Artificial Sequence
  Synthetic Oligonucleotide
agaucugucgacuucuguuuu

SEQ ID NO: 8243 - RNA, 21 nt, Artificial Sequence
  Synthetic Oligonucleotide
cuacaaggccauauuugugac

SEQ ID NO: 8244 - RNA, 21 nt, Artificial Sequence
  Synthetic Oligonucleotide
uacaugucuuuaaaacagugg

SEQ ID NO: 8245 - RNA, 21 nt, Artificial Sequence
  Synthetic Oligonucleotide
guaauuccccacuucaauaca

SEQ ID NO: 8246 - RNA, 21 nt, Artificial Sequence
  Synthetic Oligonucleotide
gucuggaugaugugcguaaca

SEQ ID NO: 8247 - RNA, 21 nt, Artificial Sequence
  Synthetic Oligonucleotide
uggagguagcaaacacuaagg

SEQ ID NO: 8248 - RNA, 21 nt, Artificial Sequence
  Synthetic Oligonucleotide
uucuuagagagaaauaaagca

SEQ ID NO: 8249 - RNA, 21 nt, Artificial Sequence
  Synthetic Oligonucleotide
auguuuuaggauguauguuac

SEQ ID NO: 8250 - RNA, 21 nt, Artificial Sequence
  Synthetic Oligonucleotide
auguccucgagauacuaaagg

SEQ ID NO: 8251 - RNA, 21 nt, Artificial Sequence
  Synthetic Oligonucleotide
gccugauucacaacuuugaga

SEQ ID NO: 8252 - RNA, 21 nt, Artificial Sequence
  Synthetic Oligonucleotide
uucuguuuacaugucuuuaaa

SEQ ID NO: 8253 - RNA, 21 nt, Artificial Sequence
  Synthetic Oligonucleotide
aagauaucaaauggcugagaa

SEQ ID NO: 8254 - RNA, 21 nt, Artificial Sequence
  Synthetic Oligonucleotide
uuuggcugauaauauugcagc

SEQ ID NO: 8255 - RNA, 21 nt, Artificial Sequence
  Synthetic Oligonucleotide
uccagauggaagcuguaucca

SEQ ID NO: 8256 - RNA, 21 nt, Artificial Sequence
  Synthetic Oligonucleotide
acuucguuggcugcaacugua

SEQ ID NO: 8257 - RNA, 21 nt, Artificial Sequence
  Synthetic Oligonucleotide
gaagguagcacuggagagaau

SEQ ID NO: 8258 - RNA, 21 nt, Artificial Sequence
  Synthetic Oligonucleotide
aauguugcugaaacagaucug

SEQ ID NO: 8259 - RNA, 21 nt, Artificial Sequence
  Synthetic Oligonucleotide
cguuggcugcaacuguauauc

SEQ ID NO: 8260 - RNA, 21 nt, Artificial Sequence
  Synthetic Oligonucleotide
uuagaaagaaauggacuuuca

SEQ ID NO: 8261 - RNA, 21 nt, Artificial Sequence
  Synthetic Oligonucleotide
agugcacaauauuuucccauc

SEQ ID NO: 8262 - RNA, 21 nt, Artificial Sequence
  Synthetic Oligonucleotide
cagugcacaauauuuucccau

SEQ ID NO: 8263 - RNA, 21 nt, Artificial Sequence
  Synthetic Oligonucleotide
gauucacaacuuugagaaggu

SEQ ID NO: 8264 - RNA, 21 nt, Artificial Sequence
  Synthetic Oligonucleotide
gaugcuccggaauguugcuga

SEQ ID NO: 8265 - RNA, 21 nt, Artificial Sequence
  Synthetic Oligonucleotide
cuucaauacaaagggugucgu

SEQ ID NO: 8266 - RNA, 21 nt, Artificial Sequence
  Synthetic Oligonucleotide
ugcaacuguauaucuacaagg

SEQ ID NO: 8267 - RNA, 21 nt, Artificial Sequence
  Synthetic Oligonucleotide
uuugaauguagauuuccaauc

SEQ ID NO: 8268 - RNA, 21 nt, Artificial Sequence
  Synthetic Oligonucleotide
ggauguauguuacuucuuaga

SEQ ID NO: 8269 - RNA, 21 nt, Artificial Sequence
  Synthetic Oligonucleotide
aauguuuuaggauguauguua

SEQ ID NO: 8270 - RNA, 21 nt, Artificial Sequence
  Synthetic Oligonucleotide
gaugaugugcguaacagauuc

SEQ ID NO: 8271 - RNA, 21 nt, Artificial Sequence
  Synthetic Oligonucleotide
uuaguaaaauuggagguagca

SEQ ID NO: 8272 - RNA, 21 nt, Artificial Sequence
  Synthetic Oligonucleotide
agguguucaagauguccucga

SEQ ID NO: 8273 - RNA, 21 nt, Artificial Sequence
  Synthetic Oligonucleotide
uuacuucuuagagagaaauaa

SEQ ID NO: 8274 - RNA, 21 nt, Artificial Sequence
  Synthetic Oligonucleotide
ugacagugcacaauauuuucc

SEQ ID NO: 8275 - RNA, 21 nt, Artificial Sequence
  Synthetic Oligonucleotide
aagguguucaagauguccucg

SEQ ID NO: 8276 - RNA, 21 nt, Artificial Sequence
  Synthetic Oligonucleotide
auguuacuucuuagagagaaa

SEQ ID NO: 8277 - RNA, 21 nt, Artificial Sequence
  Synthetic Oligonucleotide
aauacaaagggugucguucuu

SEQ ID NO: 8278 - RNA, 21 nt, Artificial Sequence
  Synthetic Oligonucleotide
acaugucuuuaaaacaguggu

SEQ ID NO: 8279 - RNA, 21 nt, Artificial Sequence
  Synthetic Oligonucleotide
gcagagggugaccacagucug

SEQ ID NO: 8280 - RNA, 21 nt, Artificial Sequence
  Synthetic Oligonucleotide
ccaaggaugcuccggaauguu

SEQ ID NO: 8281 - RNA, 21 nt, Artificial Sequence
  Synthetic Oligonucleotide
agagagaaauaaagcauuuuu

SEQ ID NO: 8282 - RNA, 21 nt, Artificial Sequence
  Synthetic Oligonucleotide
ucuuugaauguagauuuccaa

SEQ ID NO: 8283 - RNA, 21 nt, Artificial Sequence
  Synthetic Oligonucleotide
cuguuuacaugucuuuaaaac

SEQ ID NO: 8284 - RNA, 21 nt, Artificial Sequence
  Synthetic Oligonucleotide
aauuggagguagcaaacacua

SEQ ID NO: 8285 - RNA, 21 nt, Artificial Sequence
  Synthetic Oligonucleotide
cuaaagcaauagacccaucua

SEQ ID NO: 8286 - RNA, 21 nt, Artificial Sequence
  Synthetic Oligonucleotide
caacaugcuaaaucaguacuu

SEQ ID NO: 8287 - RNA, 21 nt, Artificial Sequence
  Synthetic Oligonucleotide
uacuucuuugaauguagauuu

SEQ ID NO: 8288 - RNA, 21 nt, Artificial Sequence
  Synthetic Oligonucleotide
ugccaauuguugcaaagggca

SEQ ID NO: 8289 - RNA, 21 nt, Artificial Sequence
  Synthetic Oligonucleotide
ggcuaaagugcuguauccuuu

SEQ ID NO: 8290 - RNA, 21 nt, Artificial Sequence
  Synthetic Oligonucleotide
guauuacuugacaaagagaca

SEQ ID NO: 8291 - RNA, 21 nt, Artificial Sequence
  Synthetic Oligonucleotide
gguucuuaaauuguaagcuca

SEQ ID NO: 8292 - RNA, 21 nt, Artificial Sequence
  Synthetic Oligonucleotide
ugaaacagaucugucgacuuc

SEQ ID NO: 8293 - RNA, 21 nt, Artificial Sequence
  Synthetic Oligonucleotide
gauaauauugcagcauuuucc

SEQ ID NO: 8294 - RNA, 21 nt, Artificial Sequence
  Synthetic Oligonucleotide
cugauucacaacuuugagaag

SEQ ID NO: 8295 - RNA, 21 nt, Artificial Sequence
  Synthetic Oligonucleotide
cugcauauguggcuaaagcaa

SEQ ID NO: 8296 - RNA, 21 nt, Artificial Sequence
  Synthetic Oligonucleotide
aagggugucguucuuuuccaa

SEQ ID NO: 8297 - RNA, 21 nt, Artificial Sequence
  Synthetic Oligonucleotide
aaccgucuggaugaugugcgu

SEQ ID NO: 8298 - RNA, 21 nt, Artificial Sequence
  Synthetic Oligonucleotide
ccuaggaaccuuuuagaaaga

SEQ ID NO: 8299 - RNA, 21 nt, Artificial Sequence
  Synthetic Oligonucleotide
cagccacuauugauguucugc

SEQ ID NO: 8300 - RNA, 21 nt, Artificial Sequence
  Synthetic Oligonucleotide
uucaauacaaagggugucguu

SEQ ID NO: 8301 - RNA, 21 nt, Artificial Sequence
  Synthetic Oligonucleotide
cuucuuugaauguagauuucc

SEQ ID NO: 8302 - RNA, 21 nt, Artificial Sequence
  Synthetic Oligonucleotide
cuucguuggcugcaacuguau

SEQ ID NO: 8303 - RNA, 21 nt, Artificial Sequence
  Synthetic Oligonucleotide
uagcaauaaccugugaaaaug

SEQ ID NO: 8304 - RNA, 21 nt, Artificial Sequence
  Synthetic Oligonucleotide
aaagucuauauaugacuauua

SEQ ID NO: 8305 - RNA, 21 nt, Artificial Sequence
  Synthetic Oligonucleotide
aucauuuucuccugaggaaaa

SEQ ID NO: 8306 - RNA, 21 nt, Artificial Sequence
  Synthetic Oligonucleotide
ugcauauguggcuaaagcaau

SEQ ID NO: 8307 - RNA, 21 nt, Artificial Sequence
  Synthetic Oligonucleotide
gacgacaguggacuugcugca

SEQ ID NO: 8308 - RNA, 21 nt, Artificial Sequence
  Synthetic Oligonucleotide
guuuccaagaucugacagugc

SEQ ID NO: 8309 - RNA, 21 nt, Artificial Sequence
  Synthetic Oligonucleotide
aaaugaugaagaaacuuuggc

SEQ ID NO: 8310 - RNA, 21 nt, Artificial Sequence
  Synthetic Oligonucleotide
cagagggugaccacagucugu

SEQ ID NO: 8311 - RNA, 21 nt, Artificial Sequence
  Synthetic Oligonucleotide
agagaaauaaagcauuuuugg

SEQ ID NO: 8312 - RNA, 21 nt, Artificial Sequence
  Synthetic Oligonucleotide
uugaaugggaucuuggugucg

SEQ ID NO: 8313 - RNA, 21 nt, Artificial Sequence
  Synthetic Oligonucleotide
cuguaauuccccacuucaaua

SEQ ID NO: 8314 - RNA, 21 nt, Artificial Sequence
  Synthetic Oligonucleotide
ugcuguauccuuuaguaaaau

SEQ ID NO: 8315 - RNA, 21 nt, Artificial Sequence
  Synthetic Oligonucleotide
gagaagguagcacuggagaga

SEQ ID NO: 8316 - RNA, 21 nt, Artificial Sequence
  Synthetic Oligonucleotide
ccagccacuauugauguucug

SEQ ID NO: 8317 - RNA, 21 nt, Artificial Sequence
  Synthetic Oligonucleotide
cugacagugcacaauauuuuc

SEQ ID NO: 8318 - RNA, 21 nt, Artificial Sequence
  Synthetic Oligonucleotide
uguccuaggaaccuuuuagaa

SEQ ID NO: 8319 - RNA, 21 nt, Artificial Sequence
  Synthetic Oligonucleotide
ugaaugggaucuuggugucga

SEQ ID NO: 8320 - RNA, 21 nt, Artificial Sequence
  Synthetic Oligonucleotide
agagggugaccacagucugua

SEQ ID NO: 8321 - RNA, 21 nt, Artificial Sequence
  Synthetic Oligonucleotide
agaucugacagugcacaauau

SEQ ID NO: 8322 - RNA, 21 nt, Artificial Sequence
  Synthetic Oligonucleotide
guacuuccaaagucuauauau

SEQ ID NO: 8323 - RNA, 21 nt, Artificial Sequence
  Synthetic Oligonucleotide
uuuagaaagaaauggacuuuc

SEQ ID NO: 8324 - RNA, 21 nt, Artificial Sequence
  Synthetic Oligonucleotide
gagugggugccagaaugugaa

SEQ ID NO: 8325 - RNA, 21 nt, Artificial Sequence
  Synthetic Oligonucleotide
cugaggaaaauuuuggagacg

SEQ ID NO: 8326 - RNA, 21 nt, Artificial Sequence
  Synthetic Oligonucleotide
uggggugccagccacuauuga

SEQ ID NO: 8327 - RNA, 21 nt, Artificial Sequence
  Synthetic Oligonucleotide
ccccggcuaauuuguaucaau

SEQ ID NO: 8328 - RNA, 21 nt, Artificial Sequence
  Synthetic Oligonucleotide
ugcagagggugaccacagucu

SEQ ID NO: 8329 - RNA, 21 nt, Artificial Sequence
  Synthetic Oligonucleotide
acaaggccauauuugugacag

SEQ ID NO: 8330 - RNA, 21 nt, Artificial Sequence
  Synthetic Oligonucleotide
gucuuuaaaacagugguucuu

SEQ ID NO: 8331 - RNA, 21 nt, Artificial Sequence
  Synthetic Oligonucleotide
uccucgagauacuaaaggaag

SEQ ID NO: 8332 - RNA, 21 nt, Artificial Sequence
  Synthetic Oligonucleotide
aaagcaauagacccaucuauc

SEQ ID NO: 8333 - RNA, 21 nt, Artificial Sequence
  Synthetic Oligonucleotide
gcauuuuccagauggaagcug

SEQ ID NO: 8334 - RNA, 21 nt, Artificial Sequence
  Synthetic Oligonucleotide
caugcuaaaucaguacuucca

SEQ ID NO: 8335 - RNA, 21 nt, Artificial Sequence
  Synthetic Oligonucleotide
ccuuuuagaaagaaauggacu

SEQ ID NO: 8336 - RNA, 21 nt, Artificial Sequence
  Synthetic Oligonucleotide
aguacuuuaucauuuucuccu

SEQ ID NO: 8337 - RNA, 21 nt, Artificial Sequence
  Synthetic Oligonucleotide
cuaaaucaguacuuccaaagu

SEQ ID NO: 8338 - RNA, 21 nt, Artificial Sequence
  Synthetic Oligonucleotide
aacagaucugucgacuucugu

SEQ ID NO: 8339 - RNA, 21 nt, Artificial Sequence
  Synthetic Oligonucleotide
aagacauuggugaggaaaaau

SEQ ID NO: 8340 - RNA, 21 nt, Artificial Sequence
  Synthetic Oligonucleotide
uuuccaacaaaauagcaaucc

SEQ ID NO: 8341 - RNA, 21 nt, Artificial Sequence
  Synthetic Oligonucleotide
aaacagaucugucgacuucug

SEQ ID NO: 8342 - RNA, 21 nt, Artificial Sequence
  Synthetic Oligonucleotide
caacuguauaucuacaaggac

SEQ ID NO: 8343 - RNA, 21 nt, Artificial Sequence
  Synthetic Oligonucleotide
ccugauucacaacuuugagaa

SEQ ID NO: 8344 - RNA, 21 nt, Artificial Sequence
  Synthetic Oligonucleotide
gaaacuuuggcugauaauauu

SEQ ID NO: 8345 - RNA, 21 nt, Artificial Sequence
  Synthetic Oligonucleotide
uuccaaucacaucuuuagugu

SEQ ID NO: 8346 - RNA, 21 nt, Artificial Sequence
  Synthetic Oligonucleotide
augcuccggaauguugcugaa

SEQ ID NO: 8347 - RNA, 21 nt, Artificial Sequence
  Synthetic Oligonucleotide
uguaauuccccacuucaauac

SEQ ID NO: 8348 - RNA, 21 nt, Artificial Sequence
  Synthetic Oligonucleotide
gaaccuuuuagaaagaaaugg

SEQ ID NO: 8349 - RNA, 21 nt, Artificial Sequence
  Synthetic Oligonucleotide
gguguucaagauguccucgag

SEQ ID NO: 8350 - RNA, 21 nt, Artificial Sequence
  Synthetic Oligonucleotide
uaauuccccacuucaauacaa

SEQ ID NO: 8351 - RNA, 21 nt, Artificial Sequence
  Synthetic Oligonucleotide
uggcugcaacuguauaucuac

SEQ ID NO: 8352 - RNA, 21 nt, Artificial Sequence
  Synthetic Oligonucleotide
augucuuuaaaacagugguuc

SEQ ID NO: 8353 - RNA, 21 nt, Artificial Sequence
  Synthetic Oligonucleotide
ggacagagggucagcaugcca

SEQ ID NO: 8354 - RNA, 21 nt, Artificial Sequence
  Synthetic Oligonucleotide
aagauguccucgagauacuaa

SEQ ID NO: 8355 - RNA, 21 nt, Artificial Sequence
  Synthetic Oligonucleotide
uggcgguaauuggugauacuu

SEQ ID NO: 8356 - RNA, 21 nt, Artificial Sequence
  Synthetic Oligonucleotide
cuucuuagagagaaauaaagc

SEQ ID NO: 8357 - RNA, 21 nt, Artificial Sequence
  Synthetic Oligonucleotide
guaaaauuggagguagcaaac

SEQ ID NO: 8358 - RNA, 21 nt, Artificial Sequence
  Synthetic Oligonucleotide
ugucuuuaaaacagugguucu

SEQ ID NO: 8359 - RNA, 21 nt, Artificial Sequence
  Synthetic Oligonucleotide
uaggauguauguuacuucuua

SEQ ID NO: 8360 - RNA, 21 nt, Artificial Sequence
  Synthetic Oligonucleotide
cuguauccuuuaguaaaauug

SEQ ID NO: 8361 - RNA, 21 nt, Artificial Sequence
  Synthetic Oligonucleotide
cagcauuuuccagauggaagc

SEQ ID NO: 8362 - RNA, 21 nt, Artificial Sequence
  Synthetic Oligonucleotide
ucacaacuuugagaagguagc

SEQ ID NO: 8363 - RNA, 21 nt, Artificial Sequence
  Synthetic Oligonucleotide
guucuuuuccaacaaaauagc

SEQ ID NO: 8364 - RNA, 21 nt, Artificial Sequence
  Synthetic Oligonucleotide
cugagugggugccagaaugug

SEQ ID NO: 8365 - RNA, 21 nt, Artificial Sequence
  Synthetic Oligonucleotide
uaucaaauggcugagaagacu

SEQ ID NO: 8366 - RNA, 21 nt, Artificial Sequence
  Synthetic Oligonucleotide
ugccgccacaacucaggauga

SEQ ID NO: 8367 - RNA, 21 nt, Artificial Sequence
  Synthetic Oligonucleotide
aaggaugcuccggaauguugc

SEQ ID NO: 8368 - RNA, 21 nt, Artificial Sequence
  Synthetic Oligonucleotide
ggagguagcaaacacuaaggu

SEQ ID NO: 8369 - RNA, 21 nt, Artificial Sequence
  Synthetic Oligonucleotide
ccacagucuguaauuccccac

SEQ ID NO: 8370 - RNA, 21 nt, Artificial Sequence
  Synthetic Oligonucleotide
gaauguugcugaaacagaucu

SEQ ID NO: 8371 - RNA, 21 nt, Artificial Sequence
  Synthetic Oligonucleotide
gcuaaaucaguacuuccaaag

SEQ ID NO: 8372 - RNA, 21 nt, Artificial Sequence
  Synthetic Oligonucleotide
gcaacuguauaucuacaagga

SEQ ID NO: 8373 - RNA, 21 nt, Artificial Sequence
  Synthetic Oligonucleotide
aacaugcuaaaucaguacuuc

SEQ ID NO: 8374 - RNA, 21 nt, Artificial Sequence
  Synthetic Oligonucleotide
agauaucaaauggcugagaag

SEQ ID NO: 8375 - RNA, 21 nt, Artificial Sequence
  Synthetic Oligonucleotide
uacuucuuagagagaaauaaa

SEQ ID NO: 8376 - RNA, 21 nt, Artificial Sequence
  Synthetic Oligonucleotide
accgucuggaugaugugcgua

SEQ ID NO: 8377 - RNA, 21 nt, Artificial Sequence
  Synthetic Oligonucleotide
uugccaauuguugcaaagggc

SEQ ID NO: 8378 - RNA, 21 nt, Artificial Sequence
  Synthetic Oligonucleotide
uacaaagggugucguucuuuu

SEQ ID NO: 8379 - RNA, 21 nt, Artificial Sequence
  Synthetic Oligonucleotide
agucaucgacaagacauuggu

SEQ ID NO: 8380 - RNA, 21 nt, Artificial Sequence
  Synthetic Oligonucleotide
acuuuggcugauaauauugca

SEQ ID NO: 8381 - RNA, 21 nt, Artificial Sequence
  Synthetic Oligonucleotide
gacuugcugcauauguggcua

SEQ ID NO: 8382 - RNA, 21 nt, Artificial Sequence
  Synthetic Oligonucleotide
ucuuuuccaacaaaauagcaa

SEQ ID NO: 8383 - RNA, 21 nt, Artificial Sequence
  Synthetic Oligonucleotide
cccacuucaauacaaagggug

SEQ ID NO: 8384 - RNA, 21 nt, Artificial Sequence
  Synthetic Oligonucleotide
uauauccaaauguuuuaggau

SEQ ID NO: 8385 - RNA, 21 nt, Artificial Sequence
  Synthetic Oligonucleotide
caucuaucagcugggaagaua

SEQ ID NO: 8386 - RNA, 21 nt, Artificial Sequence
  Synthetic Oligonucleotide
acgacaguggacuugcugcau

SEQ ID NO: 8387 - RNA, 21 nt, Artificial Sequence
  Synthetic Oligonucleotide
guguccuaggaaccuuuuaga

SEQ ID NO: 8388 - RNA, 21 nt, Artificial Sequence
  Synthetic Oligonucleotide
gaccacagucuguaauucccc

SEQ ID NO: 8389 - RNA, 21 nt, Artificial Sequence
  Synthetic Oligonucleotide
caaccgucuggaugaugugcg

SEQ ID NO: 8390 - RNA, 21 nt, Artificial Sequence
  Synthetic Oligonucleotide
ggcugcaacuguauaucuaca

SEQ ID NO: 8391 - RNA, 21 nt, Artificial Sequence
  Synthetic Oligonucleotide
uccaaggaugcuccggaaugu

SEQ ID NO: 8392 - RNA, 21 nt, Artificial Sequence
  Synthetic Oligonucleotide
caaggaugcuccggaauguug

SEQ ID NO: 8393 - RNA, 21 nt, Artificial Sequence
  Synthetic Oligonucleotide
auguugcugaaacagaucugu

SEQ ID NO: 8394 - RNA, 21 nt, Artificial Sequence
  Synthetic Oligonucleotide
caaagggcauuuugagaggug

SEQ ID NO: 8395 - RNA, 21 nt, Artificial Sequence
  Synthetic Oligonucleotide
gcuaaagcaauagacccaucu

SEQ ID NO: 8396 - RNA, 21 nt, Artificial Sequence
  Synthetic Oligonucleotide
uucaagauguccucgagauac

SEQ ID NO: 8397 - RNA, 21 nt, Artificial Sequence
  Synthetic Oligonucleotide
gugaccacagucuguaauucc

SEQ ID NO: 8398 - RNA, 21 nt, Artificial Sequence
  Synthetic Oligonucleotide
gaaagucaucgacaagacauu

SEQ ID NO: 8399 - RNA, 21 nt, Artificial Sequence
  Synthetic Oligonucleotide
ugggaagauaucaaauggcug

SEQ ID NO: 8400 - RNA, 21 nt, Artificial Sequence
  Synthetic Oligonucleotide
cuccugaggaaaauuuuggag

SEQ ID NO: 8401 - RNA, 21 nt, Artificial Sequence
  Synthetic Oligonucleotide
uugauguucugccagaaauug

SEQ ID NO: 8402 - RNA, 21 nt, Artificial Sequence
  Synthetic Oligonucleotide
ugccagccacuauugauguuc

SEQ ID NO: 8403 - RNA, 21 nt, Artificial Sequence
  Synthetic Oligonucleotide
acaaagggugucguucuuuuc

SEQ ID NO: 8404 - RNA, 21 nt, Artificial Sequence
  Synthetic Oligonucleotide
caucgacaagacauuggugag

SEQ ID NO: 8405 - RNA, 21 nt, Artificial Sequence
  Synthetic Oligonucleotide
ggaaaggcacugauguucuga

SEQ ID NO: 8406 - RNA, 21 nt, Artificial Sequence
  Synthetic Oligonucleotide
agggugaccacagucuguaau

SEQ ID NO: 8407 - RNA, 21 nt, Artificial Sequence
  Synthetic Oligonucleotide
gccgccacaacucaggaugaa

SEQ ID NO: 8408 - RNA, 21 nt, Artificial Sequence
  Synthetic Oligonucleotide
guggcgguaauuggugauacu

SEQ ID NO: 8409 - RNA, 21 nt, Artificial Sequence
  Synthetic Oligonucleotide
auugcuuuugacuuuucaaug

SEQ ID NO: 8410 - RNA, 21 nt, Artificial Sequence
  Synthetic Oligonucleotide
caauggguguccuaggaaccu

SEQ ID NO: 8411 - RNA, 21 nt, Artificial Sequence
  Synthetic Oligonucleotide
auuggagguagcaaacacuaa

SEQ ID NO: 8412 - RNA, 21 nt, Artificial Sequence
  Synthetic Oligonucleotide
gcugaaacagaucugucgacu

SEQ ID NO: 8413 - RNA, 21 nt, Artificial Sequence
  Synthetic Oligonucleotide
uacaaggccauauuugugaca

SEQ ID NO: 8414 - RNA, 21 nt, Artificial Sequence
  Synthetic Oligonucleotide
auugcagcauuuuccagaugg

SEQ ID NO: 8415 - RNA, 21 nt, Artificial Sequence
  Synthetic Oligonucleotide
ugcuaaaucaguacuuccaaa

SEQ ID NO: 8416 - RNA, 21 nt, Artificial Sequence
  Synthetic Oligonucleotide
cagugguucuuaaauuguaag

SEQ ID NO: 8417 - RNA, 21 nt, Artificial Sequence
  Synthetic Oligonucleotide
cauugcuuuugacuuuucaau

SEQ ID NO: 8418 - RNA, 21 nt, Artificial Sequence
  Synthetic Oligonucleotide
gagagaaauaaagcauuuuug

SEQ ID NO: 8419 - RNA, 21 nt, Artificial Sequence
  Synthetic Oligonucleotide
auguagauuuccaaucacauc

SEQ ID NO: 8420 - RNA, 21 nt, Artificial Sequence
  Synthetic Oligonucleotide
uuccagauggaagcuguaucc

SEQ ID NO: 8421 - RNA, 21 nt, Artificial Sequence
  Synthetic Oligonucleotide
caauuguugcaaagggcauuu

SEQ ID NO: 8422 - RNA, 21 nt, Artificial Sequence
  Synthetic Oligonucleotide
aucuacaaggaccgagaaguc

SEQ ID NO: 8423 - RNA, 21 nt, Artificial Sequence
  Synthetic Oligonucleotide
uuugagaagguagcacuggag

SEQ ID NO: 8424 - RNA, 21 nt, Artificial Sequence
  Synthetic Oligonucleotide
uuggagguagcaaacacuaag

SEQ ID NO: 8425 - RNA, 21 nt, Artificial Sequence
  Synthetic Oligonucleotide
acaaggaccgagaagucacca

SEQ ID NO: 8426 - RNA, 21 nt, Artificial Sequence
  Synthetic Oligonucleotide
ggcuacaaggccauauuugug

SEQ ID NO: 8427 - RNA, 21 nt, Artificial Sequence
  Synthetic Oligonucleotide
ccaguacuuuaucauuuucuc

SEQ ID NO: 8428 - RNA, 21 nt, Artificial Sequence
  Synthetic Oligonucleotide
uagauuuccaaucacaucuuu

SEQ ID NO: 8429 - RNA, 21 nt, Artificial Sequence
  Synthetic Oligonucleotide
uuuaggauguauguuacuucu

SEQ ID NO: 8430 - RNA, 21 nt, Artificial Sequence
  Synthetic Oligonucleotide
acuuuaucauuuucuccugag

SEQ ID NO: 8431 - RNA, 21 nt, Artificial Sequence
  Synthetic Oligonucleotide
cgucuggaugaugugcguaac

SEQ ID NO: 8432 - RNA, 21 nt, Artificial Sequence
  Synthetic Oligonucleotide
acuguauaucuacaaggaccg

SEQ ID NO: 8433 - RNA, 21 nt, Artificial Sequence
  Synthetic Oligonucleotide
caaaugaugaagaaacuuugg

SEQ ID NO: 8434 - RNA, 21 nt, Artificial Sequence
  Synthetic Oligonucleotide
cagaucugucgacuucuguuu

SEQ ID NO: 8435 - RNA, 21 nt, Artificial Sequence
  Synthetic Oligonucleotide
aagguagcacuggagagaauu

SEQ ID NO: 8436 - RNA, 21 nt, Artificial Sequence
  Synthetic Oligonucleotide
gaaagaaauggacuuucaucc

SEQ ID NO: 8437 - RNA, 21 nt, Artificial Sequence
  Synthetic Oligonucleotide
gaaaggcacugauguucugaa

SEQ ID NO: 8438 - RNA, 21 nt, Artificial Sequence
  Synthetic Oligonucleotide
aauggcugagaagacugacau

SEQ ID NO: 8439 - RNA, 21 nt, Artificial Sequence
  Synthetic Oligonucleotide
gccagccacuauugauguucu

SEQ ID NO: 8440 - RNA, 21 nt, Artificial Sequence
  Synthetic Oligonucleotide
cugcaacuguauaucuacaag

SEQ ID NO: 8441 - RNA, 21 nt, Artificial Sequence
  Synthetic Oligonucleotide
agaaagguguucaagaugucc

SEQ ID NO: 8442 - RNA, 21 nt, Artificial Sequence
  Synthetic Oligonucleotide
uguuuuaggauguauguuacu

SEQ ID NO: 8443 - RNA, 21 nt, Artificial Sequence
  Synthetic Oligonucleotide
uggguguccuaggaaccuuuu

SEQ ID NO: 8444 - RNA, 21 nt, Artificial Sequence
  Synthetic Oligonucleotide
gaaacagaucugucgacuucu

SEQ ID NO: 8445 - RNA, 21 nt, Artificial Sequence
  Synthetic Oligonucleotide
ggaagauaucaaauggcugag

SEQ ID NO: 8446 - RNA, 21 nt, Artificial Sequence
  Synthetic Oligonucleotide
auauugcagcauuuuccagau

SEQ ID NO: 8447 - RNA, 21 nt, Artificial Sequence
  Synthetic Oligonucleotide
ucaauacaaagggugucguuc

SEQ ID NO: 8448 - RNA, 21 nt, Artificial Sequence
  Synthetic Oligonucleotide
ugacuuuucaauggguguccu

SEQ ID NO: 8449 - RNA, 21 nt, Artificial Sequence
  Synthetic Oligonucleotide
uugcuuuugacuuuucaaugg

SEQ ID NO: 8450 - RNA, 21 nt, Artificial Sequence
  Synthetic Oligonucleotide
uguugcugaaacagaucuguc

SEQ ID NO: 8451 - RNA, 21 nt, Artificial Sequence
  Synthetic Oligonucleotide
cggaauguugcugaaacagau

SEQ ID NO: 8452 - RNA, 21 nt, Artificial Sequence
  Synthetic Oligonucleotide
aggcuaaagugcuguauccuu

SEQ ID NO: 8453 - RNA, 21 nt, Artificial Sequence
  Synthetic Oligonucleotide
caggcuaaagugcuguauccu

SEQ ID NO: 8454 - RNA, 21 nt, Artificial Sequence
  Synthetic Oligonucleotide
uugagaagguagcacuggaga

SEQ ID NO: 8455 - RNA, 21 nt, Artificial Sequence
  Synthetic Oligonucleotide
guggcuaaagcaauagaccca

SEQ ID NO: 8456 - RNA, 21 nt, Artificial Sequence
  Synthetic Oligonucleotide
ccaauuguugcaaagggcauu

SEQ ID NO: 8457 - RNA, 21 nt, Artificial Sequence
  Synthetic Oligonucleotide
uuuaguaaaauuggagguagc

SEQ ID NO: 8458 - RNA, 21 nt, Artificial Sequence
  Synthetic Oligonucleotide
uguauaucuacaaggaccgag

SEQ ID NO: 8459 - RNA, 21 nt, Artificial Sequence
  Synthetic Oligonucleotide
cauauguggcuaaagcaauag

SEQ ID NO: 8460 - RNA, 21 nt, Artificial Sequence
  Synthetic Oligonucleotide
aaauuggagguagcaaacacu

SEQ ID NO: 8461 - RNA, 21 nt, Artificial Sequence
  Synthetic Oligonucleotide
guauaucuacaaggaccgaga

SEQ ID NO: 8462 - RNA, 21 nt, Artificial Sequence
  Synthetic Oligonucleotide
caguggacuugcugcauaugu

SEQ ID NO: 8463 - RNA, 21 nt, Artificial Sequence
  Synthetic Oligonucleotide
uguauccuuuaguaaaauugg

SEQ ID NO: 8464 - RNA, 21 nt, Artificial Sequence
  Synthetic Oligonucleotide
auuacuugacaaagagacacu

SEQ ID NO: 8465 - RNA, 21 nt, Artificial Sequence
  Synthetic Oligonucleotide
uugacuuuucaaugggugucc

SEQ ID NO: 8466 - RNA, 21 nt, Artificial Sequence
  Synthetic Oligonucleotide
uuuuagaaagaaauggacuuu

SEQ ID NO: 8467 - RNA, 21 nt, Artificial Sequence
  Synthetic Oligonucleotide
ggaugcuccggaauguugcug

SEQ ID NO: 8468 - RNA, 21 nt, Artificial Sequence
  Synthetic Oligonucleotide
uagaaagaaauggacuuucau

SEQ ID NO: 8469 - RNA, 21 nt, Artificial Sequence
  Synthetic Oligonucleotide
uguuuacaugucuuuaaaaca

SEQ ID NO: 8470 - RNA, 21 nt, Artificial Sequence
  Synthetic Oligonucleotide
aaugaugaagaaacuuuggcu

SEQ ID NO: 8471 - RNA, 21 nt, Artificial Sequence
  Synthetic Oligonucleotide
agacgacaguggacuugcugc

SEQ ID NO: 8472 - RNA, 21 nt, Artificial Sequence
  Synthetic Oligonucleotide
acagaucugucgacuucuguu

SEQ ID NO: 8473 - RNA, 21 nt, Artificial Sequence
  Synthetic Oligonucleotide
auauguggcuaaagcaauaga

SEQ ID NO: 8474 - RNA, 21 nt, Artificial Sequence
  Synthetic Oligonucleotide
ugcggaaaggcacugauguuc

SEQ ID NO: 8475 - RNA, 21 nt, Artificial Sequence
  Synthetic Oligonucleotide
gcugcauauguggcuaaagca

SEQ ID NO: 8476 - RNA, 21 nt, Artificial Sequence
  Synthetic Oligonucleotide
uggagacgacaguggacuugc

SEQ ID NO: 8477 - RNA, 21 nt, Artificial Sequence
  Synthetic Oligonucleotide
gugcagagggugaccacaguc

SEQ ID NO: 8478 - RNA, 21 nt, Artificial Sequence
  Synthetic Oligonucleotide
ucuuuagugucugaauauauc

SEQ ID NO: 8479 - RNA, 21 nt, Artificial Sequence
  Synthetic Oligonucleotide
guucaagauguccucgagaua

SEQ ID NO: 8480 - RNA, 21 nt, Artificial Sequence
  Synthetic Oligonucleotide
aguaaaauuggagguagcaaa

SEQ ID NO: 8481 - RNA, 21 nt, Artificial Sequence
  Synthetic Oligonucleotide
auucacaacuuugagaaggua

SEQ ID NO: 8482 - RNA, 21 nt, Artificial Sequence
  Synthetic Oligonucleotide
gauaucaaauggcugagaaga

SEQ ID NO: 8483 - RNA, 21 nt, Artificial Sequence
  Synthetic Oligonucleotide
ggagaaagguguucaagaugu

SEQ ID NO: 8484 - RNA, 21 nt, Artificial Sequence
  Synthetic Oligonucleotide
guagauuuccaaucacaucuu

SEQ ID NO: 8485 - RNA, 21 nt, Artificial Sequence
  Synthetic Oligonucleotide
cuuugaauguagauuuccaau

SEQ ID NO: 8486 - RNA, 21 nt, Artificial Sequence
  Synthetic Oligonucleotide
uauugcagcauuuuccagaug

SEQ ID NO: 8487 - RNA, 21 nt, Artificial Sequence
  Synthetic Oligonucleotide
ccccacuucaauacaaagggu

SEQ ID NO: 8488 - RNA, 21 nt, Artificial Sequence
  Synthetic Oligonucleotide
acuucuuugaauguagauuuc

SEQ ID NO: 8489 - RNA, 21 nt, Artificial Sequence
  Synthetic Oligonucleotide
acuugcugcauauguggcuaa

SEQ ID NO: 8490 - RNA, 21 nt, Artificial Sequence
  Synthetic Oligonucleotide
aauggguguccuaggaaccuu

SEQ ID NO: 8491 - RNA, 21 nt, Artificial Sequence
  Synthetic Oligonucleotide
ggcuaaagcaauagacccauc

SEQ ID NO: 8492 - RNA, 21 nt, Artificial Sequence
  Synthetic Oligonucleotide
ucgagauacuaaaggaagaau

SEQ ID NO: 8493 - RNA, 21 nt, Artificial Sequence
  Synthetic Oligonucleotide
ugugcggaaaggcacugaugu

SEQ ID NO: 8494 - RNA, 21 nt, Artificial Sequence
  Synthetic Oligonucleotide
uuuuaggauguauguuacuuc

SEQ ID NO: 8495 - RNA, 21 nt, Artificial Sequence
  Synthetic Oligonucleotide
gaggaaaauuuuggagacgac

SEQ ID NO: 8496 - RNA, 21 nt, Artificial Sequence
  Synthetic Oligonucleotide
ccuuuaguaaaauuggaggua

SEQ ID NO: 8497 - RNA, 21 nt, Artificial Sequence
  Synthetic Oligonucleotide
aggacagagggucagcaugcc

SEQ ID NO: 8498 - RNA, 21 nt, Artificial Sequence
  Synthetic Oligonucleotide
ucugucgacuucuguuuuagg

SEQ ID NO: 8499 - RNA, 21 nt, Artificial Sequence
  Synthetic Oligonucleotide
guuuuaggauguauguuacuu

SEQ ID NO: 8500 - RNA, 21 nt, Artificial Sequence
  Synthetic Oligonucleotide
guagcacuggagagaauugga

SEQ ID NO: 8501 - RNA, 21 nt, Artificial Sequence
  Synthetic Oligonucleotide
aaaauuggagguagcaaacac

SEQ ID NO: 8502 - RNA, 21 nt, Artificial Sequence
  Synthetic Oligonucleotide
auggcugagaagacugacauc

SEQ ID NO: 8503 - RNA, 21 nt, Artificial Sequence
  Synthetic Oligonucleotide
uuuccaaucacaucuuuagug

SEQ ID NO: 8504 - RNA, 21 nt, Artificial Sequence
  Synthetic Oligonucleotide
acuucaauacaaagggugucg

SEQ ID NO: 8505 - RNA, 21 nt, Artificial Sequence
  Synthetic Oligonucleotide
cuguauaucuacaaggaccga

SEQ ID NO: 8506 - RNA, 21 nt, Artificial Sequence
  Synthetic Oligonucleotide
ggacuugcugcauauguggcu

SEQ ID NO: 8507 - RNA, 21 nt, Artificial Sequence
  Synthetic Oligonucleotide
aaacuuuggcugauaauauug

SEQ ID NO: 8508 - RNA, 21 nt, Artificial Sequence
  Synthetic Oligonucleotide
aaauuuuggagacgacagugg

SEQ ID NO: 8509 - RNA, 21 nt, Artificial Sequence
  Synthetic Oligonucleotide
aucugucgacuucuguuuuag

SEQ ID NO: 8510 - RNA, 21 nt, Artificial Sequence
  Synthetic Oligonucleotide
gucuggggcaaaugaugaaga

SEQ ID NO: 8511 - RNA, 21 nt, Artificial Sequence
  Synthetic Oligonucleotide
uucuccugaggaaaauuuugg

SEQ ID NO: 8512 - RNA, 21 nt, Artificial Sequence
  Synthetic Oligonucleotide
uguggcuaaagcaauagaccc

SEQ ID NO: 8513 - RNA, 21 nt, Artificial Sequence
  Synthetic Oligonucleotide
gacagagggucagcaugccaa

SEQ ID NO: 8514 - RNA, 21 nt, Artificial Sequence
  Synthetic Oligonucleotide
cuuuugacuuuucaaugggug

SEQ ID NO: 8515 - RNA, 21 nt, Artificial Sequence
  Synthetic Oligonucleotide
cggaaaggcacugauguucug

SEQ ID NO: 8516 - RNA, 21 nt, Artificial Sequence
  Synthetic Oligonucleotide
accacagucuguaauucccca

SEQ ID NO: 8517 - RNA, 21 nt, Artificial Sequence
  Synthetic Oligonucleotide
cuuuggcugauaauauugcag

SEQ ID NO: 8518 - RNA, 21 nt, Artificial Sequence
  Synthetic Oligonucleotide
aggaaccuuuuagaaagaaau

SEQ ID NO: 8519 - RNA, 21 nt, Artificial Sequence
  Synthetic Oligonucleotide
guccucgagauacuaaaggaa

SEQ ID NO: 8520 - RNA, 21 nt, Artificial Sequence
  Synthetic Oligonucleotide
cgagauacuaaaggaagaauu

SEQ ID NO: 8521 - RNA, 21 nt, Artificial Sequence
  Synthetic Oligonucleotide
cccaucuaucagcugggaaga

SEQ ID NO: 8522 - RNA, 21 nt, Artificial Sequence
  Synthetic Oligonucleotide
ugcugaaacagaucugucgac

SEQ ID NO: 8523 - RNA, 21 nt, Artificial Sequence
  Synthetic Oligonucleotide
cuuuaguaaaauuggagguag

SEQ ID NO: 8524 - RNA, 21 nt, Artificial Sequence
  Synthetic Oligonucleotide
agagacacugugcagagggug

SEQ ID NO: 8525 - RNA, 21 nt, Artificial Sequence
  Synthetic Oligonucleotide
auccuuuaguaaaauuggagg

SEQ ID NO: 8526 - RNA, 21 nt, Artificial Sequence
  Synthetic Oligonucleotide
gcagcauuuuccagauggaag

SEQ ID NO: 8527 - RNA, 21 nt, Artificial Sequence
  Synthetic Oligonucleotide
aacuguauaucuacaaggacc

SEQ ID NO: 8528 - RNA, 21 nt, Artificial Sequence
  Synthetic Oligonucleotide
gcuuuugacuuuucaaugggu

SEQ ID NO: 8529 - RNA, 21 nt, Artificial Sequence
  Synthetic Oligonucleotide
gcuaaagugcuguauccuuua

SEQ ID NO: 8530 - RNA, 21 nt, Artificial Sequence
  Synthetic Oligonucleotide
guccuaggaaccuuuuagaaa

SEQ ID NO: 8531 - RNA, 21 nt, Artificial Sequence
  Synthetic Oligonucleotide
aaagagacacugugcagaggg

SEQ ID NO: 8532 - RNA, 21 nt, Artificial Sequence
  Synthetic Oligonucleotide
auggguguccuaggaaccuuu

SEQ ID NO: 8533 - RNA, 21 nt, Artificial Sequence
  Synthetic Oligonucleotide
agacccaucuaucagcuggga

SEQ ID NO: 8534 - RNA, 21 nt, Artificial Sequence
  Synthetic Oligonucleotide
auuuucuccugaggaaaauuu

SEQ ID NO: 8535 - RNA, 21 nt, Artificial Sequence
  Synthetic Oligonucleotide
uaaagcaauagacccaucuau

SEQ ID NO: 8536 - RNA, 21 nt, Artificial Sequence
  Synthetic Oligonucleotide
auggggugccagccacuauug

SEQ ID NO: 8537 - RNA, 21 nt, Artificial Sequence
  Synthetic Oligonucleotide
cugaaacagaucugucgacuu

SEQ ID NO: 8538 - RNA, 21 nt, Artificial Sequence
  Synthetic Oligonucleotide
uccccacuucaauacaaaggg

SEQ ID NO: 8539 - RNA, 21 nt, Artificial Sequence
  Synthetic Oligonucleotide
guuuacaugucuuuaaaacag

SEQ ID NO: 8540 - RNA, 21 nt, Artificial Sequence
  Synthetic Oligonucleotide
ugagaagguagcacuggagag

SEQ ID NO: 8541 - RNA, 21 nt, Artificial Sequence
  Synthetic Oligonucleotide
cuguauccaaggaugcuccgg

SEQ ID NO: 8542 - RNA, 21 nt, Artificial Sequence
  Synthetic Oligonucleotide
ugcaaagggcauuuugagagg

SEQ ID NO: 8543 - RNA, 21 nt, Artificial Sequence
  Synthetic Oligonucleotide
uggguggcgguaauuggugau

SEQ ID NO: 8544 - RNA, 21 nt, Artificial Sequence
  Synthetic Oligonucleotide
gccaauuguugcaaagggcau

SEQ ID NO: 8545 - RNA, 21 nt, Artificial Sequence
  Synthetic Oligonucleotide
aauguagauuuccaaucacau

SEQ ID NO: 8546 - RNA, 21 nt, Artificial Sequence
  Synthetic Oligonucleotide
ugacaaagagacacugugcag

SEQ ID NO: 8547 - RNA, 21 nt, Artificial Sequence
  Synthetic Oligonucleotide
uugcugaaacagaucugucga

SEQ ID NO: 8548 - RNA, 21 nt, Artificial Sequence
  Synthetic Oligonucleotide
uccugaggaaaauuuuggaga

SEQ ID NO: 8549 - RNA, 21 nt, Artificial Sequence
  Synthetic Oligonucleotide
cuuagagagaaauaaagcauu

SEQ ID NO: 8550 - RNA, 21 nt, Artificial Sequence
  Synthetic Oligonucleotide
uggcuaaagcaauagacccau

SEQ ID NO: 8551 - RNA, 21 nt, Artificial Sequence
  Synthetic Oligonucleotide
uccuaggaaccuuuuagaaag

SEQ ID NO: 8552 - RNA, 21 nt, Artificial Sequence
  Synthetic Oligonucleotide
acaucauugccaauuguugca

SEQ ID NO: 8553 - RNA, 21 nt, Artificial Sequence
  Synthetic Oligonucleotide
ccagauggaagcuguauccaa

SEQ ID NO: 8554 - RNA, 21 nt, Artificial Sequence
  Synthetic Oligonucleotide
cugugcagagggugaccacag

SEQ ID NO: 8555 - RNA, 21 nt, Artificial Sequence
  Synthetic Oligonucleotide
agauggaagcuguauccaagg

SEQ ID NO: 8556 - RNA, 21 nt, Artificial Sequence
  Synthetic Oligonucleotide
caucauugccaauuguugcaa

SEQ ID NO: 8557 - RNA, 21 nt, Artificial Sequence
  Synthetic Oligonucleotide
aaagucaucgacaagacauug

SEQ ID NO: 8558 - RNA, 21 nt, Artificial Sequence
  Synthetic Oligonucleotide
auguggcuaaagcaauagacc

SEQ ID NO: 8559 - RNA, 21 nt, Artificial Sequence
  Synthetic Oligonucleotide
ccgucuggaugaugugcguaa

SEQ ID NO: 8560 - RNA, 21 nt, Artificial Sequence
  Synthetic Oligonucleotide
ugcuccggaauguugcugaaa

SEQ ID NO: 8561 - RNA, 21 nt, Artificial Sequence
  Synthetic Oligonucleotide
uuuuccaacaaaauagcaauc

SEQ ID NO: 8562 - RNA, 21 nt, Artificial Sequence
  Synthetic Oligonucleotide
cuuuuagaaagaaauggacuu

SEQ ID NO: 8563 - RNA, 21 nt, Artificial Sequence
  Synthetic Oligonucleotide
gcggaaaggcacugauguucu

SEQ ID NO: 8564 - RNA, 21 nt, Artificial Sequence
  Synthetic Oligonucleotide
gaaagguguucaagauguccu

SEQ ID NO: 8565 - RNA, 21 nt, Artificial Sequence
  Synthetic Oligonucleotide
gagaaagguguucaagauguc

SEQ ID NO: 8566 - RNA, 21 nt, Artificial Sequence
  Synthetic Oligonucleotide
auuguugcaaagggcauuuug

SEQ ID NO: 8567 - RNA, 21 nt, Artificial Sequence
  Synthetic Oligonucleotide
cguucuuuuccaacaaaauag

SEQ ID NO: 8568 - RNA, 21 nt, Artificial Sequence
  Synthetic Oligonucleotide
ccacuucaauacaaagggugu

SEQ ID NO: 8569 - RNA, 21 nt, Artificial Sequence
  Synthetic Oligonucleotide
uuuccaagaucugacagugca

SEQ ID NO: 8570 - RNA, 21 nt, Artificial Sequence
  Synthetic Oligonucleotide
cacuucaauacaaaggguguc

SEQ ID NO: 8571 - RNA, 21 nt, Artificial Sequence
  Synthetic Oligonucleotide
acuuugagaagguagcacugg

SEQ ID NO: 8572 - RNA, 21 nt, Artificial Sequence
  Synthetic Oligonucleotide
cugccgccacaacucaggaug

SEQ ID NO: 8573 - RNA, 21 nt, Artificial Sequence
  Synthetic Oligonucleotide
guugcugaaacagaucugucg

SEQ ID NO: 8574 - RNA, 21 nt, Artificial Sequence
  Synthetic Oligonucleotide
ggaaccuuuuagaaagaaaug

SEQ ID NO: 8575 - RNA, 21 nt, Artificial Sequence
  Synthetic Oligonucleotide
caugucuuuaaaacagugguu

SEQ ID NO: 8576 - RNA, 21 nt, Artificial Sequence
  Synthetic Oligonucleotide
auugauguucugccagaaauu

SEQ ID NO: 8577 - RNA, 21 nt, Artificial Sequence
  Synthetic Oligonucleotide
ggggugccagccacuauugau

SEQ ID NO: 8578 - RNA, 21 nt, Artificial Sequence
  Synthetic Oligonucleotide
gagacgacaguggacuugcug

SEQ ID NO: 8579 - RNA, 21 nt, Artificial Sequence
  Synthetic Oligonucleotide
uguugcaaagggcauuuugag

SEQ ID NO: 8580 - RNA, 21 nt, Artificial Sequence
  Synthetic Oligonucleotide
aaggaccgagaagucaccaag

SEQ ID NO: 8581 - RNA, 21 nt, Artificial Sequence
  Synthetic Oligonucleotide
cuccggaauguugcugaaaca

SEQ ID NO: 8582 - RNA, 21 nt, Artificial Sequence
  Synthetic Oligonucleotide
caggucuggggcaaaugauga

SEQ ID NO: 8583 - RNA, 21 nt, Artificial Sequence
  Synthetic Oligonucleotide
gugccagccacuauugauguu

SEQ ID NO: 8584 - RNA, 21 nt, Artificial Sequence
  Synthetic Oligonucleotide
gugcggaaaggcacugauguu

SEQ ID NO: 8585 - RNA, 21 nt, Artificial Sequence
  Synthetic Oligonucleotide
cuugcugcauauguggcuaaa

SEQ ID NO: 8586 - RNA, 21 nt, Artificial Sequence
  Synthetic Oligonucleotide
cugggaagauaucaaauggcu

SEQ ID NO: 8587 - RNA, 21 nt, Artificial Sequence
  Synthetic Oligonucleotide
gguguccuaggaaccuuuuag

SEQ ID NO: 8588 - RNA, 21 nt, Artificial Sequence
  Synthetic Oligonucleotide
cucgagauacuaaaggaagaa

SEQ ID NO: 8589 - RNA, 21 nt, Artificial Sequence
  Synthetic Oligonucleotide
ugggcuacaaggccauauuug

SEQ ID NO: 8590 - RNA, 21 nt, Artificial Sequence
  Synthetic Oligonucleotide
uucacaacuuugagaagguag

SEQ ID NO: 8591 - RNA, 21 nt, Artificial Sequence
  Synthetic Oligonucleotide
gcacuucguuggcugcaacug

SEQ ID NO: 8592 - RNA, 21 nt, Artificial Sequence
  Synthetic Oligonucleotide
ugauguucugccagaaauugu

SEQ ID NO: 8593 - RNA, 21 nt, Artificial Sequence
  Synthetic Oligonucleotide
uguagauuuccaaucacaucu

SEQ ID NO: 8594 - RNA, 21 nt, Artificial Sequence
  Synthetic Oligonucleotide
uggacuugcugcauauguggc

SEQ ID NO: 8595 - RNA, 21 nt, Artificial Sequence
  Synthetic Oligonucleotide
agcauuuuccagauggaagcu

SEQ ID NO: 8596 - RNA, 21 nt, Artificial Sequence
  Synthetic Oligonucleotide
agacauuggugaggaaaaauc

SEQ ID NO: 8597 - RNA, 21 nt, Artificial Sequence
  Synthetic Oligonucleotide
ggugccagccacuauugaugu

SEQ ID NO: 8598 - RNA, 21 nt, Artificial Sequence
  Synthetic Oligonucleotide
uacaaggaccgagaagucacc

SEQ ID NO: 8599 - RNA, 21 nt, Artificial Sequence
  Synthetic Oligonucleotide
caaggccauauuugugacagu

SEQ ID NO: 8600 - RNA, 21 nt, Artificial Sequence
  Synthetic Oligonucleotide
gguggcgguaauuggugauac

SEQ ID NO: 8601 - RNA, 21 nt, Artificial Sequence
  Synthetic Oligonucleotide
uguauccaaggaugcuccgga

SEQ ID NO: 8602 - RNA, 21 nt, Artificial Sequence
  Synthetic Oligonucleotide
cagauggaagcuguauccaag

SEQ ID NO: 8603 - RNA, 21 nt, Artificial Sequence
  Synthetic Oligonucleotide
ucaauggguguccuaggaacc

SEQ ID NO: 8604 - RNA, 21 nt, Artificial Sequence
  Synthetic Oligonucleotide
acaacuuugagaagguagcac

SEQ ID NO: 8605 - RNA, 21 nt, Artificial Sequence
  Synthetic Oligonucleotide
uuacaugucuuuaaaacagug

SEQ ID NO: 8606 - RNA, 21 nt, Artificial Sequence
  Synthetic Oligonucleotide
aauggguggcgguaauuggug

SEQ ID NO: 8607 - RNA, 21 nt, Artificial Sequence
  Synthetic Oligonucleotide
uuuucaauggguguccuagga

SEQ ID NO: 8608 - RNA, 21 nt, Artificial Sequence
  Synthetic Oligonucleotide
cuugacaaagagacacugugc

SEQ ID NO: 8609 - RNA, 21 nt, Artificial Sequence
  Synthetic Oligonucleotide
agaaagaaauggacuuucauc

SEQ ID NO: 8610 - RNA, 21 nt, Artificial Sequence
  Synthetic Oligonucleotide
gcuguauccuuuaguaaaauu

SEQ ID NO: 8611 - RNA, 21 nt, Artificial Sequence
  Synthetic Oligonucleotide
cuaucagcugggaagauauca

SEQ ID NO: 8612 - RNA, 21 nt, Artificial Sequence
  Synthetic Oligonucleotide
gggugccagccacuauugaug

SEQ ID NO: 8613 - RNA, 21 nt, Artificial Sequence
  Synthetic Oligonucleotide
uacaggucuggggcaaaugau

SEQ ID NO: 8614 - RNA, 21 nt, Artificial Sequence
  Synthetic Oligonucleotide
gugggugccagaaugugaaag

SEQ ID NO: 8615 - RNA, 21 nt, Artificial Sequence
  Synthetic Oligonucleotide
gauggaagcuguauccaagga

SEQ ID NO: 8616 - RNA, 21 nt, Artificial Sequence
  Synthetic Oligonucleotide
ucugagugggugccagaaugu

SEQ ID NO: 8617 - RNA, 21 nt, Artificial Sequence
  Synthetic Oligonucleotide
auuuuccagauggaagcugua

SEQ ID NO: 8618 - RNA, 21 nt, Artificial Sequence
  Synthetic Oligonucleotide
auaucuacaaggaccgagaag

SEQ ID NO: 8619 - RNA, 21 nt, Artificial Sequence
  Synthetic Oligonucleotide
ugaggaaaauuuuggagacga

SEQ ID NO: 8620 - RNA, 21 nt, Artificial Sequence
  Synthetic Oligonucleotide
gagggugaccacagucuguaa

SEQ ID NO: 8621 - RNA, 21 nt, Artificial Sequence
  Synthetic Oligonucleotide
uugacaaagagacacugugca

SEQ ID NO: 8622 - RNA, 21 nt, Artificial Sequence
  Synthetic Oligonucleotide
aaagguguucaagauguccuc

SEQ ID NO: 8623 - RNA, 21 nt, Artificial Sequence
  Synthetic Oligonucleotide
uagcacuggagagaauuggaa

SEQ ID NO: 8624 - RNA, 21 nt, Artificial Sequence
  Synthetic Oligonucleotide
uuuacaugucuuuaaaacagu

SEQ ID NO: 8625 - RNA, 21 nt, Artificial Sequence
  Synthetic Oligonucleotide
ccgagaagucaccaagaagcu

SEQ ID NO: 8626 - RNA, 21 nt, Artificial Sequence
  Synthetic Oligonucleotide
agucuauauaugacuauuaca

SEQ ID NO: 8627 - RNA, 21 nt, Artificial Sequence
  Synthetic Oligonucleotide
gucuauauaugacuauuacag

SEQ ID NO: 8628 - RNA, 21 nt, Artificial Sequence
  Synthetic Oligonucleotide
gcaaagggcauuuugagaggu

SEQ ID NO: 8629 - RNA, 21 nt, Artificial Sequence
  Synthetic Oligonucleotide
gggaagauaucaaauggcuga

SEQ ID NO: 8630 - RNA, 21 nt, Artificial Sequence
  Synthetic Oligonucleotide
acagauucaaacugccgccac

SEQ ID NO: 8631 - RNA, 21 nt, Artificial Sequence
  Synthetic Oligonucleotide
aggaugcuccggaauguugcu

SEQ ID NO: 8632 - RNA, 21 nt, Artificial Sequence
  Synthetic Oligonucleotide
ccugaggaaaauuuuggagac

SEQ ID NO: 8633 - RNA, 21 nt, Artificial Sequence
  Synthetic Oligonucleotide
cuacaaggaccgagaagucac

SEQ ID NO: 8634 - RNA, 21 nt, Artificial Sequence
  Synthetic Oligonucleotide
gcaaaugaugaagaaacuuug

SEQ ID NO: 8635 - RNA, 21 nt, Artificial Sequence
  Synthetic Oligonucleotide
aaaggcacugauguucugaaa

SEQ ID NO: 8636 - RNA, 21 nt, Artificial Sequence
  Synthetic Oligonucleotide
ggcaaaugaugaagaaacuuu

SEQ ID NO: 8637 - RNA, 21 nt, Artificial Sequence
  Synthetic Oligonucleotide
auggguggcgguaauugguga

SEQ ID NO: 8638 - RNA, 21 nt, Artificial Sequence
  Synthetic Oligonucleotide
ucuggggcaaaugaugaagaa

SEQ ID NO: 8639 - RNA, 21 nt, Artificial Sequence
  Synthetic Oligonucleotide
gaauggguggcgguaauuggu

SEQ ID NO: 8640 - RNA, 21 nt, Artificial Sequence
  Synthetic Oligonucleotide
cugucgacuucuguuuuagga

SEQ ID NO: 8641 - RNA, 21 nt, Artificial Sequence
  Synthetic Oligonucleotide
gcugcaacuguauaucuacaa

SEQ ID NO: 8642 - RNA, 21 nt, Artificial Sequence
  Synthetic Oligonucleotide
gcauauguggcuaaagcaaua

SEQ ID NO: 8643 - RNA, 21 nt, Artificial Sequence
  Synthetic Oligonucleotide
aacugccgccacaacucagga

SEQ ID NO: 8644 - RNA, 21 nt, Artificial Sequence
  Synthetic Oligonucleotide
ucuaucagcugggaagauauc

SEQ ID NO: 8645 - RNA, 21 nt, Artificial Sequence
  Synthetic Oligonucleotide
uaaaauuggagguagcaaaca

SEQ ID NO: 8646 - RNA, 21 nt, Artificial Sequence
  Synthetic Oligonucleotide
gacauuggugaggaaaaaucc

SEQ ID NO: 8647 - RNA, 21 nt, Artificial Sequence
  Synthetic Oligonucleotide
acaaagagacacugugcagag

SEQ ID NO: 8648 - RNA, 21 nt, Artificial Sequence
  Synthetic Oligonucleotide
ugaccacagucuguaauuccc

SEQ ID NO: 8649 - RNA, 21 nt, Artificial Sequence
  Synthetic Oligonucleotide
gggagaaagguguucaagaug

SEQ ID NO: 8650 - RNA, 21 nt, Artificial Sequence
  Synthetic Oligonucleotide
cuuugagaagguagcacugga

SEQ ID NO: 8651 - RNA, 21 nt, Artificial Sequence
  Synthetic Oligonucleotide
aaagggcauuuugagagguga

SEQ ID NO: 8652 - RNA, 21 nt, Artificial Sequence
  Synthetic Oligonucleotide
uuacaggucuggggcaaauga

SEQ ID NO: 8653 - RNA, 21 nt, Artificial Sequence
  Synthetic Oligonucleotide
cauuuucuccugaggaaaauu

SEQ ID NO: 8654 - RNA, 21 nt, Artificial Sequence
  Synthetic Oligonucleotide
guauccuuuaguaaaauugga

SEQ ID NO: 8655 - RNA, 21 nt, Artificial Sequence
  Synthetic Oligonucleotide
aucuaucagcugggaagauau

SEQ ID NO: 8656 - RNA, 21 nt, Artificial Sequence
  Synthetic Oligonucleotide
cugggccaccuccucaauuga

SEQ ID NO: 8657 - RNA, 21 nt, Artificial Sequence
  Synthetic Oligonucleotide
ucuacaaggaccgagaaguca

SEQ ID NO: 8658 - RNA, 21 nt, Artificial Sequence
  Synthetic Oligonucleotide
ggaauggguggcgguaauugg

SEQ ID NO: 8659 - RNA, 21 nt, Artificial Sequence
  Synthetic Oligonucleotide
gggcuacaaggccauauuugu

SEQ ID NO: 8660 - RNA, 21 nt, Artificial Sequence
  Synthetic Oligonucleotide
uuuucuccugaggaaaauuuu

SEQ ID NO: 8661 - RNA, 21 nt, Artificial Sequence
  Synthetic Oligonucleotide
aggaccgagaagucaccaaga

SEQ ID NO: 8662 - RNA, 21 nt, Artificial Sequence
  Synthetic Oligonucleotide
ggguguccuaggaaccuuuua

SEQ ID NO: 8663 - RNA, 21 nt, Artificial Sequence
  Synthetic Oligonucleotide
accgagaagucaccaagaagc

SEQ ID NO: 8664 - RNA, 21 nt, Artificial Sequence
  Synthetic Oligonucleotide
ccucgagauacuaaaggaaga

SEQ ID NO: 8665 - RNA, 21 nt, Artificial Sequence
  Synthetic Oligonucleotide
ggagacgacaguggacuugcu

SEQ ID NO: 8666 - RNA, 21 nt, Artificial Sequence
  Synthetic Oligonucleotide
uagacccaucuaucagcuggg

SEQ ID NO: 8667 - RNA, 21 nt, Artificial Sequence
  Synthetic Oligonucleotide
cucugagugggugccagaaug

SEQ ID NO: 8668 - RNA, 21 nt, Artificial Sequence
  Synthetic Oligonucleotide
gacaaagagacacugugcaga

SEQ ID NO: 8669 - RNA, 21 nt, Artificial Sequence
  Synthetic Oligonucleotide
uugcugcauauguggcuaaag

SEQ ID NO: 8670 - RNA, 21 nt, Artificial Sequence
  Synthetic Oligonucleotide
acuucuuagagagaaauaaag

SEQ ID NO: 8671 - RNA, 21 nt, Artificial Sequence
  Synthetic Oligonucleotide
uucaauggguguccuaggaac

SEQ ID NO: 8672 - RNA, 21 nt, Artificial Sequence
  Synthetic Oligonucleotide
acccaucuaucagcugggaag

SEQ ID NO: 8673 - RNA, 21 nt, Artificial Sequence
  Synthetic Oligonucleotide
ucuauauaugacuauuacagg

SEQ ID NO: 8674 - RNA, 21 nt, Artificial Sequence
  Synthetic Oligonucleotide
acaggucuggggcaaaugaug

SEQ ID NO: 8675 - RNA, 21 nt, Artificial Sequence
  Synthetic Oligonucleotide
caauagacccaucuaucagcu

SEQ ID NO: 8676 - RNA, 21 nt, Artificial Sequence
  Synthetic Oligonucleotide
auugccaauuguugcaaaggg

SEQ ID NO: 8677 - RNA, 21 nt, Artificial Sequence
  Synthetic Oligonucleotide
agauguccucgagauacuaaa

SEQ ID NO: 8678 - RNA, 21 nt, Artificial Sequence
  Synthetic Oligonucleotide
uuguugcaaagggcauuuuga

SEQ ID NO: 8679 - RNA, 21 nt, Artificial Sequence
  Synthetic Oligonucleotide
gugugcggaaaggcacugaug

SEQ ID NO: 8680 - RNA, 21 nt, Artificial Sequence
  Synthetic Oligonucleotide
gcuccggaauguugcugaaac

SEQ ID NO: 8681 - RNA, 21 nt, Artificial Sequence
  Synthetic Oligonucleotide
agguagcacuggagagaauug

SEQ ID NO: 8682 - RNA, 21 nt, Artificial Sequence
  Synthetic Oligonucleotide
cgacaguggacuugcugcaua

SEQ ID NO: 8683 - RNA, 21 nt, Artificial Sequence
  Synthetic Oligonucleotide
acaguggacuugcugcauaug

SEQ ID NO: 8684 - RNA, 21 nt, Artificial Sequence
  Synthetic Oligonucleotide
ugaggcacuucguuggcugca

SEQ ID NO: 8685 - RNA, 21 nt, Artificial Sequence
  Synthetic Oligonucleotide
auuuccaaucacaucuuuagu

SEQ ID NO: 8686 - RNA, 21 nt, Artificial Sequence
  Synthetic Oligonucleotide
aauuuuggagacgacagugga

SEQ ID NO: 8687 - RNA, 21 nt, Artificial Sequence
  Synthetic Oligonucleotide
uauccuuuaguaaaauuggag

SEQ ID NO: 8688 - RNA, 21 nt, Artificial Sequence
  Synthetic Oligonucleotide
cuugaaugggaucuugguguc

SEQ ID NO: 8689 - RNA, 21 nt, Artificial Sequence
  Synthetic Oligonucleotide
gcacugauguucugaaagcuc

SEQ ID NO: 8690 - RNA, 21 nt, Artificial Sequence
  Synthetic Oligonucleotide
agcuugccacugugagagccu

SEQ ID NO: 8691 - RNA, 21 nt, Artificial Sequence
  Synthetic Oligonucleotide
ggaaaauuuuggagacgacag

SEQ ID NO: 8692 - RNA, 21 nt, Artificial Sequence
  Synthetic Oligonucleotide
gggugaccacagucuguaauu

SEQ ID NO: 8693 - RNA, 21 nt, Artificial Sequence
  Synthetic Oligonucleotide
uaggacagagggucagcaugc

SEQ ID NO: 8694 - RNA, 21 nt, Artificial Sequence
  Synthetic Oligonucleotide
ggguggcgguaauuggugaua

SEQ ID NO: 8695 - RNA, 21 nt, Artificial Sequence
  Synthetic Oligonucleotide
gggcauuuugagaggugauga

SEQ ID NO: 8696 - RNA, 21 nt, Artificial Sequence
  Synthetic Oligonucleotide
auggaagcuguauccaaggau

SEQ ID NO: 8697 - RNA, 21 nt, Artificial Sequence
  Synthetic Oligonucleotide
gguagcacuggagagaauugg

SEQ ID NO: 8698 - RNA, 21 nt, Artificial Sequence
  Synthetic Oligonucleotide
ggaccgagaagucaccaagaa

SEQ ID NO: 8699 - RNA, 21 nt, Artificial Sequence
  Synthetic Oligonucleotide
gacccaucuaucagcugggaa

SEQ ID NO: 8700 - RNA, 21 nt, Artificial Sequence
  Synthetic Oligonucleotide
agggaggcuguuaaacauggc

SEQ ID NO: 8701 - RNA, 21 nt, Artificial Sequence
  Synthetic Oligonucleotide
caaggaccgagaagucaccaa

SEQ ID NO: 8702 - RNA, 21 nt, Artificial Sequence
  Synthetic Oligonucleotide
gcugggaagauaucaaauggc

SEQ ID NO: 8703 - RNA, 21 nt, Artificial Sequence
  Synthetic Oligonucleotide
uaucagcugggaagauaucaa

SEQ ID NO: 8704 - RNA, 21 nt, Artificial Sequence
  Synthetic Oligonucleotide
guuaaacauggcuugaauggg

SEQ ID NO: 8705 - RNA, 21 nt, Artificial Sequence
  Synthetic Oligonucleotide
aggaaaauuuuggagacgaca

SEQ ID NO: 8706 - RNA, 21 nt, Artificial Sequence
  Synthetic Oligonucleotide
ggggagaaagguguucaagau

SEQ ID NO: 8707 - RNA, 21 nt, Artificial Sequence
  Synthetic Oligonucleotide
guugcaaagggcauuuugaga

SEQ ID NO: 8708 - RNA, 21 nt, Artificial Sequence
  Synthetic Oligonucleotide
aauuguugcaaagggcauuuu

SEQ ID NO: 8709 - RNA, 21 nt, Artificial Sequence
  Synthetic Oligonucleotide
cuuuuccaacaaaauagcaau

SEQ ID NO: 8710 - RNA, 21 nt, Artificial Sequence
  Synthetic Oligonucleotide
aauuccccacuucaauacaaa

SEQ ID NO: 8711 - RNA, 21 nt, Artificial Sequence
  Synthetic Oligonucleotide
ugacuauuacaggucuggggc

SEQ ID NO: 8712 - RNA, 21 nt, Artificial Sequence
  Synthetic Oligonucleotide
agaaauuguggaggcugugga

SEQ ID NO: 8713 - RNA, 21 nt, Artificial Sequence
  Synthetic Oligonucleotide
ugugcagagggugaccacagu

SEQ ID NO: 8714 - RNA, 21 nt, Artificial Sequence
  Synthetic Oligonucleotide
aucauugccaauuguugcaaa

SEQ ID NO: 8715 - RNA, 21 nt, Artificial Sequence
  Synthetic Oligonucleotide
guauccaaggaugcuccggaa

SEQ ID NO: 8716 - RNA, 21 nt, Artificial Sequence
  Synthetic Oligonucleotide
gagauacuaaaggaagaauuc

SEQ ID NO: 8717 - RNA, 21 nt, Artificial Sequence
  Synthetic Oligonucleotide
aagagacacugugcagagggu

SEQ ID NO: 8718 - RNA, 21 nt, Artificial Sequence
  Synthetic Oligonucleotide
gaaaauuuuggagacgacagu

SEQ ID NO: 8719 - RNA, 21 nt, Artificial Sequence
  Synthetic Oligonucleotide
gaucugucgacuucuguuuua

SEQ ID NO: 8720 - RNA, 21 nt, Artificial Sequence
  Synthetic Oligonucleotide
ggugaccacagucuguaauuc

SEQ ID NO: 8721 - RNA, 21 nt, Artificial Sequence
  Synthetic Oligonucleotide
cacugugcagagggugaccac

SEQ ID NO: 8722 - RNA, 21 nt, Artificial Sequence
  Synthetic Oligonucleotide
uuucaauggguguccuaggaa

SEQ ID NO: 8723 - RNA, 21 nt, Artificial Sequence
  Synthetic Oligonucleotide
cuuuucaauggguguccuagg

SEQ ID NO: 8724 - RNA, 21 nt, Artificial Sequence
  Synthetic Oligonucleotide
gggugugcggaaaggcacuga

SEQ ID NO: 8725 - RNA, 21 nt, Artificial Sequence
  Synthetic Oligonucleotide
uauguggcuaaagcaauagac

SEQ ID NO: 8726 - RNA, 21 nt, Artificial Sequence
  Synthetic Oligonucleotide
ucgacuucuguuuuaggacag

SEQ ID NO: 8727 - RNA, 21 nt, Artificial Sequence
  Synthetic Oligonucleotide
agauuuccaaucacaucuuua

SEQ ID NO: 8728 - RNA, 21 nt, Artificial Sequence
  Synthetic Oligonucleotide
gauguccucgagauacuaaag

SEQ ID NO: 8729 - RNA, 21 nt, Artificial Sequence
  Synthetic Oligonucleotide
uugcaaagggcauuuugagag

SEQ ID NO: 8730 - RNA, 21 nt, Artificial Sequence
  Synthetic Oligonucleotide
agauacuaaaggaagaauucc

SEQ ID NO: 8731 - RNA, 21 nt, Artificial Sequence
  Synthetic Oligonucleotide
ggcuugaaugggaucuuggug

SEQ ID NO: 8732 - RNA, 21 nt, Artificial Sequence
  Synthetic Oligonucleotide
ucuguuuuaggacagaggguc

SEQ ID NO: 8733 - RNA, 21 nt, Artificial Sequence
  Synthetic Oligonucleotide
cugggaacgggcaugauguug

SEQ ID NO: 8734 - RNA, 21 nt, Artificial Sequence
  Synthetic Oligonucleotide
uaucuacaaggaccgagaagu

SEQ ID NO: 8735 - RNA, 21 nt, Artificial Sequence
  Synthetic Oligonucleotide
ucuccugaggaaaauuuugga

SEQ ID NO: 8736 - RNA, 21 nt, Artificial Sequence
  Synthetic Oligonucleotide
aggcuguuaaacauggcuuga

SEQ ID NO: 8737 - RNA, 21 nt, Artificial Sequence
  Synthetic Oligonucleotide
cgauggggugccagccacuau

SEQ ID NO: 8738 - RNA, 21 nt, Artificial Sequence
  Synthetic Oligonucleotide
agaugggcuacaaggccauau

SEQ ID NO: 8739 - RNA, 21 nt, Artificial Sequence
  Synthetic Oligonucleotide
ggcuguuaaacauggcuugaa

SEQ ID NO: 8740 - RNA, 21 nt, Artificial Sequence
  Synthetic Oligonucleotide
agggcauuuugagaggugaug

SEQ ID NO: 8741 - RNA, 21 nt, Artificial Sequence
  Synthetic Oligonucleotide
aaaauuuuggagacgacagug

SEQ ID NO: 8742 - RNA, 21 nt, Artificial Sequence
  Synthetic Oligonucleotide
agugggugccagaaugugaaa

SEQ ID NO: 8743 - RNA, 21 nt, Artificial Sequence
  Synthetic Oligonucleotide
gcaaccgucuggaugaugugc

SEQ ID NO: 8744 - RNA, 21 nt, Artificial Sequence
  Synthetic Oligonucleotide
aagcaauagacccaucuauca

SEQ ID NO: 8745 - RNA, 21 nt, Artificial Sequence
  Synthetic Oligonucleotide
aguggacuugcugcauaugug

SEQ ID NO: 8746 - RNA, 21 nt, Artificial Sequence
  Synthetic Oligonucleotide
ucauugccaauuguugcaaag

SEQ ID NO: 8747 - RNA, 21 nt, Artificial Sequence
  Synthetic Oligonucleotide
gacuauuacaggucuggggca

SEQ ID NO: 8748 - RNA, 21 nt, Artificial Sequence
  Synthetic Oligonucleotide
auccaaggaugcuccggaaug

SEQ ID NO: 8749 - RNA, 21 nt, Artificial Sequence
  Synthetic Oligonucleotide
ugccagaaauuguggaggcug

SEQ ID NO: 8750 - RNA, 21 nt, Artificial Sequence
  Synthetic Oligonucleotide
gcuacaaggccauauuuguga

SEQ ID NO: 8751 - RNA, 21 nt, Artificial Sequence
  Synthetic Oligonucleotide
uggaauggguggcgguaauug

SEQ ID NO: 8752 - RNA, 21 nt, Artificial Sequence
  Synthetic Oligonucleotide
cucgauggggugccagccacu

SEQ ID NO: 8753 - RNA, 21 nt, Artificial Sequence
  Synthetic Oligonucleotide
uuaaacauggcuugaauggga

SEQ ID NO: 8754 - RNA, 21 nt, Artificial Sequence
  Synthetic Oligonucleotide
uuccccacuucaauacaaagg

SEQ ID NO: 8755 - RNA, 21 nt, Artificial Sequence
  Synthetic Oligonucleotide
ucuguuuacaugucuuuaaaa

SEQ ID NO: 8756 - RNA, 21 nt, Artificial Sequence
  Synthetic Oligonucleotide
cacugauguucugaaagcucu

SEQ ID NO: 8757 - RNA, 21 nt, Artificial Sequence
  Synthetic Oligonucleotide
gcucugagugggugccagaau

SEQ ID NO: 8758 - RNA, 21 nt, Artificial Sequence
  Synthetic Oligonucleotide
acuugacaaagagacacugug

SEQ ID NO: 8759 - RNA, 21 nt, Artificial Sequence
  Synthetic Oligonucleotide
ugucgacuucuguuuuaggac

SEQ ID NO: 8760 - RNA, 21 nt, Artificial Sequence
  Synthetic Oligonucleotide
uuggagacgacaguggacuug

SEQ ID NO: 8761 - RNA, 21 nt, Artificial Sequence
  Synthetic Oligonucleotide
aagggcauuuugagaggugau

SEQ ID NO: 8762 - RNA, 21 nt, Artificial Sequence
  Synthetic Oligonucleotide
cacaacuuugagaagguagca

SEQ ID NO: 8763 - RNA, 21 nt, Artificial Sequence
  Synthetic Oligonucleotide
augggcuacaaggccauauuu

SEQ ID NO: 8764 - RNA, 21 nt, Artificial Sequence
  Synthetic Oligonucleotide
ugggccaccuccucaauugaa

SEQ ID NO: 8765 - RNA, 21 nt, Artificial Sequence
  Synthetic Oligonucleotide
ccguuuccaagaucugacagu

SEQ ID NO: 8766 - RNA, 21 nt, Artificial Sequence
  Synthetic Oligonucleotide
ggggcaaaugaugaagaaacu

SEQ ID NO: 8767 - RNA, 21 nt, Artificial Sequence
  Synthetic Oligonucleotide
gaaugggaucuuggugucgaa

SEQ ID NO: 8768 - RNA, 21 nt, Artificial Sequence
  Synthetic Oligonucleotide
ugcguaacagauucaaacugc

SEQ ID NO: 8769 - RNA, 21 nt, Artificial Sequence
  Synthetic Oligonucleotide
gaugggcuacaaggccauauu

SEQ ID NO: 8770 - RNA, 21 nt, Artificial Sequence
  Synthetic Oligonucleotide
ugggaacgggcaugauguuga

SEQ ID NO: 8771 - RNA, 21 nt, Artificial Sequence
  Synthetic Oligonucleotide
uucuguuuuaggacagagggu

SEQ ID NO: 8772 - RNA, 21 nt, Artificial Sequence
  Synthetic Oligonucleotide
aaacugccgccacaacucagg

SEQ ID NO: 8773 - RNA, 21 nt, Artificial Sequence
  Synthetic Oligonucleotide
gagaagaugggcuacaaggcc

SEQ ID NO: 8774 - RNA, 21 nt, Artificial Sequence
  Synthetic Oligonucleotide
uaacagauucaaacugccgcc

SEQ ID NO: 8775 - RNA, 21 nt, Artificial Sequence
  Synthetic Oligonucleotide
uauccaaggaugcuccggaau

SEQ ID NO: 8776 - RNA, 21 nt, Artificial Sequence
  Synthetic Oligonucleotide
uuuccagauggaagcuguauc

SEQ ID NO: 8777 - RNA, 21 nt, Artificial Sequence
  Synthetic Oligonucleotide
gaagcuguauccaaggaugcu

SEQ ID NO: 8778 - RNA, 21 nt, Artificial Sequence
  Synthetic Oligonucleotide
ucgauggggugccagccacua

SEQ ID NO: 8779 - RNA, 21 nt, Artificial Sequence
  Synthetic Oligonucleotide
uuuuggagacgacaguggacu

SEQ ID NO: 8780 - RNA, 21 nt, Artificial Sequence
  Synthetic Oligonucleotide
uguuaaacauggcuugaaugg

SEQ ID NO: 8781 - RNA, 21 nt, Artificial Sequence
  Synthetic Oligonucleotide
aggcacuucguuggcugcaac

SEQ ID NO: 8782 - RNA, 21 nt, Artificial Sequence
  Synthetic Oligonucleotide
auggcuugaaugggaucuugg

SEQ ID NO: 8783 - RNA, 21 nt, Artificial Sequence
  Synthetic Oligonucleotide
ucagcugggaagauaucaaau

SEQ ID NO: 8784 - RNA, 21 nt, Artificial Sequence
  Synthetic Oligonucleotide
uuuuccagauggaagcuguau

SEQ ID NO: 8785 - RNA, 21 nt, Artificial Sequence
  Synthetic Oligonucleotide
agcaauagacccaucuaucag

SEQ ID NO: 8786 - RNA, 21 nt, Artificial Sequence
  Synthetic Oligonucleotide
cguuuccaagaucugacagug

SEQ ID NO: 8787 - RNA, 21 nt, Artificial Sequence
  Synthetic Oligonucleotide
caacuuugagaagguagcacu

SEQ ID NO: 8788 - RNA, 21 nt, Artificial Sequence
  Synthetic Oligonucleotide
uugccacugugagagccuguc

SEQ ID NO: 8789 - RNA, 21 nt, Artificial Sequence
  Synthetic Oligonucleotide
aacauggcuugaaugggaucu

SEQ ID NO: 8790 - RNA, 21 nt, Artificial Sequence
  Synthetic Oligonucleotide
agcugggaagauaucaaaugg

SEQ ID NO: 8791 - RNA, 21 nt, Artificial Sequence
  Synthetic Oligonucleotide
gcuugaaugggaucuuggugu

SEQ ID NO: 8792 - RNA, 21 nt, Artificial Sequence
  Synthetic Oligonucleotide
gcaauagacccaucuaucagc

SEQ ID NO: 8793 - RNA, 21 nt, Artificial Sequence
  Synthetic Oligonucleotide
uuuugacuuuucaaugggugu

SEQ ID NO: 8794 - RNA, 21 nt, Artificial Sequence
  Synthetic Oligonucleotide
uacuaaaggaagaauuccggu

SEQ ID NO: 8795 - RNA, 21 nt, Artificial Sequence
  Synthetic Oligonucleotide
acugccgccacaacucaggau

SEQ ID NO: 8796 - RNA, 21 nt, Artificial Sequence
  Synthetic Oligonucleotide
gaugugcguaacagauucaaa

SEQ ID NO: 8797 - RNA, 21 nt, Artificial Sequence
  Synthetic Oligonucleotide
gggcaaaugaugaagaaacuu

SEQ ID NO: 8798 - RNA, 21 nt, Artificial Sequence
  Synthetic Oligonucleotide
ggaacgggcaugauguugagu

SEQ ID NO: 8799 - RNA, 21 nt, Artificial Sequence
  Synthetic Oligonucleotide
uggcuugaaugggaucuuggu

SEQ ID NO: 8800 - RNA, 21 nt, Artificial Sequence
  Synthetic Oligonucleotide
acauuggugaggaaaaauccu

SEQ ID NO: 8801 - RNA, 21 nt, Artificial Sequence
  Synthetic Oligonucleotide
gucgaaucauggggcucgaca

SEQ ID NO: 8802 - RNA, 21 nt, Artificial Sequence
  Synthetic Oligonucleotide
gaagaugggcuacaaggccau

SEQ ID NO: 8803 - RNA, 21 nt, Artificial Sequence
  Synthetic Oligonucleotide
augugcguaacagauucaaac

SEQ ID NO: 8804 - RNA, 21 nt, Artificial Sequence
  Synthetic Oligonucleotide
aacuuugagaagguagcacug

SEQ ID NO: 8805 - RNA, 21 nt, Artificial Sequence
  Synthetic Oligonucleotide
cuauuacaggucuggggcaaa

SEQ ID NO: 8806 - RNA, 21 nt, Artificial Sequence
  Synthetic Oligonucleotide
uuugacuuuucaauggguguc

SEQ ID NO: 8807 - RNA, 21 nt, Artificial Sequence
  Synthetic Oligonucleotide
gacacugugcagagggugacc

SEQ ID NO: 8808 - RNA, 21 nt, Artificial Sequence
  Synthetic Oligonucleotide
cagaaauuguggaggcugugg

SEQ ID NO: 8809 - RNA, 21 nt, Artificial Sequence
  Synthetic Oligonucleotide
cauugccaauuguugcaaagg

SEQ ID NO: 8810 - RNA, 21 nt, Artificial Sequence
  Synthetic Oligonucleotide
ggcuguggaagggaaggugga

SEQ ID NO: 8811 - RNA, 21 nt, Artificial Sequence
  Synthetic Oligonucleotide
gagcuugccacugugagagcc

SEQ ID NO: 8812 - RNA, 21 nt, Artificial Sequence
  Synthetic Oligonucleotide
cuguuuuaggacagaggguca

SEQ ID NO: 8813 - RNA, 21 nt, Artificial Sequence
  Synthetic Oligonucleotide
uggaagggaagguggaagucu

SEQ ID NO: 8814 - RNA, 21 nt, Artificial Sequence
  Synthetic Oligonucleotide
uggggcaaaugaugaagaaac

SEQ ID NO: 8815 - RNA, 21 nt, Artificial Sequence
  Synthetic Oligonucleotide
caaacugccgccacaacucag

SEQ ID NO: 8816 - RNA, 21 nt, Artificial Sequence
  Synthetic Oligonucleotide
ggaagcuguauccaaggaugc

SEQ ID NO: 8817 - RNA, 21 nt, Artificial Sequence
  Synthetic Oligonucleotide
uuuuaggacagagggucagca

SEQ ID NO: 8818 - RNA, 21 nt, Artificial Sequence
  Synthetic Oligonucleotide
guggacuugcugcauaugugg

SEQ ID NO: 8819 - RNA, 21 nt, Artificial Sequence
  Synthetic Oligonucleotide
ggcucugagugggugccagaa

SEQ ID NO: 8820 - RNA, 21 nt, Artificial Sequence
  Synthetic Oligonucleotide
cuauauaugacuauuacaggu

SEQ ID NO: 8821 - RNA, 21 nt, Artificial Sequence
  Synthetic Oligonucleotide
cguaacagauucaaacugccg

SEQ ID NO: 8822 - RNA, 21 nt, Artificial Sequence
  Synthetic Oligonucleotide
gauuuccaaucacaucuuuag

SEQ ID NO: 8823 - RNA, 21 nt, Artificial Sequence
  Synthetic Oligonucleotide
caaagagacacugugcagagg

SEQ ID NO: 8824 - RNA, 21 nt, Artificial Sequence
  Synthetic Oligonucleotide
cuguggaagggaagguggaag

SEQ ID NO: 8825 - RNA, 21 nt, Artificial Sequence
  Synthetic Oligonucleotide
gaccgagaagucaccaagaag

SEQ ID NO: 8826 - RNA, 21 nt, Artificial Sequence
  Synthetic Oligonucleotide
ugggcaaccgucuggaugaug

SEQ ID NO: 8827 - RNA, 21 nt, Artificial Sequence
  Synthetic Oligonucleotide
uggcaggcuaaagugcuguau

SEQ ID NO: 8828 - RNA, 21 nt, Artificial Sequence
  Synthetic Oligonucleotide
gggaggcuguuaaacauggcu

SEQ ID NO: 8829 - RNA, 21 nt, Artificial Sequence
  Synthetic Oligonucleotide
agagaauuggaauggguggcg

SEQ ID NO: 8830 - RNA, 21 nt, Artificial Sequence
  Synthetic Oligonucleotide
gacuuuucaauggguguccua

SEQ ID NO: 8831 - RNA, 21 nt, Artificial Sequence
  Synthetic Oligonucleotide
augaugccagggaggcuguua

SEQ ID NO: 8832 - RNA, 21 nt, Artificial Sequence
  Synthetic Oligonucleotide
cagauucaaacugccgccaca

SEQ ID NO: 8833 - RNA, 21 nt, Artificial Sequence
  Synthetic Oligonucleotide
uuaggacagagggucagcaug

SEQ ID NO: 8834 - RNA, 21 nt, Artificial Sequence
  Synthetic Oligonucleotide
gagacacugugcagaggguga

SEQ ID NO: 8835 - RNA, 21 nt, Artificial Sequence
  Synthetic Oligonucleotide
uuggugucgaaucauggggcu

SEQ ID NO: 8836 - RNA, 21 nt, Artificial Sequence
  Synthetic Oligonucleotide
aauagacccaucuaucagcug

SEQ ID NO: 8837 - RNA, 21 nt, Artificial Sequence
  Synthetic Oligonucleotide
acauggcuugaaugggaucuu

SEQ ID NO: 8838 - RNA, 21 nt, Artificial Sequence
  Synthetic Oligonucleotide
uucaaacugccgccacaacuc

SEQ ID NO: 8839 - RNA, 21 nt, Artificial Sequence
  Synthetic Oligonucleotide
ugaugaugccagggaggcugu

SEQ ID NO: 8840 - RNA, 21 nt, Artificial Sequence
  Synthetic Oligonucleotide
uccugggccaccuccucaauu

SEQ ID NO: 8841 - RNA, 21 nt, Artificial Sequence
  Synthetic Oligonucleotide
ugauguucugaaagcucuggc

SEQ ID NO: 8842 - RNA, 21 nt, Artificial Sequence
  Synthetic Oligonucleotide
acuauuacaggucuggggcaa

SEQ ID NO: 8843 - RNA, 21 nt, Artificial Sequence
  Synthetic Oligonucleotide
gauggggugccagccacuauu

SEQ ID NO: 8844 - RNA, 21 nt, Artificial Sequence
  Synthetic Oligonucleotide
gucgacuucuguuuuaggaca

SEQ ID NO: 8845 - RNA, 21 nt, Artificial Sequence
  Synthetic Oligonucleotide
agacacugugcagagggugac

SEQ ID NO: 8846 - RNA, 21 nt, Artificial Sequence
  Synthetic Oligonucleotide
uuuaggacagagggucagcau

SEQ ID NO: 8847 - RNA, 21 nt, Artificial Sequence
  Synthetic Oligonucleotide
guggaagggaagguggaaguc

SEQ ID NO: 8848 - RNA, 21 nt, Artificial Sequence
  Synthetic Oligonucleotide
aaggcacugauguucugaaag

SEQ ID NO: 8849 - RNA, 21 nt, Artificial Sequence
  Synthetic Oligonucleotide
auuacaggucuggggcaaaug

SEQ ID NO: 8850 - RNA, 21 nt, Artificial Sequence
  Synthetic Oligonucleotide
gagaauuggaauggguggcgg

SEQ ID NO: 8851 - RNA, 21 nt, Artificial Sequence
  Synthetic Oligonucleotide
uauaucuacaaggaccgagaa

SEQ ID NO: 8852 - RNA, 21 nt, Artificial Sequence
  Synthetic Oligonucleotide
aacagauucaaacugccgcca

SEQ ID NO: 8853 - RNA, 21 nt, Artificial Sequence
  Synthetic Oligonucleotide
aggucuggggcaaaugaugaa

SEQ ID NO: 8854 - RNA, 21 nt, Artificial Sequence
  Synthetic Oligonucleotide
gggcaaccgucuggaugaugu

SEQ ID NO: 8855 - RNA, 21 nt, Artificial Sequence
  Synthetic Oligonucleotide
uauuacaggucuggggcaaau

SEQ ID NO: 8856 - RNA, 21 nt, Artificial Sequence
  Synthetic Oligonucleotide
cuggggcaaaugaugaagaaa

SEQ ID NO: 8857 - RNA, 21 nt, Artificial Sequence
  Synthetic Oligonucleotide
agaagaugggcuacaaggcca

SEQ ID NO: 8858 - RNA, 21 nt, Artificial Sequence
  Synthetic Oligonucleotide
uuuggagacgacaguggacuu

SEQ ID NO: 8859 - RNA, 21 nt, Artificial Sequence
  Synthetic Oligonucleotide
cauuuugagaggugaugaugc

SEQ ID NO: 8860 - RNA, 21 nt, Artificial Sequence
  Synthetic Oligonucleotide
cgagaagucaccaagaagcua

SEQ ID NO: 8861 - RNA, 21 nt, Artificial Sequence
  Synthetic Oligonucleotide
gggaacgggcaugauguugag

SEQ ID NO: 8862 - RNA, 21 nt, Artificial Sequence
  Synthetic Oligonucleotide
gaauuggaauggguggcggua

SEQ ID NO: 8863 - RNA, 21 nt, Artificial Sequence
  Synthetic Oligonucleotide
auguucugccagaaauugugg

SEQ ID NO: 8864 - RNA, 21 nt, Artificial Sequence
  Synthetic Oligonucleotide
aggcuguggaagggaaggugg

SEQ ID NO: 8865 - RNA, 21 nt, Artificial Sequence
  Synthetic Oligonucleotide
gagaccaaucguuuggggcuu

SEQ ID NO: 8866 - RNA, 21 nt, Artificial Sequence
  Synthetic Oligonucleotide
ucaaacugccgccacaacuca

SEQ ID NO: 8867 - RNA, 21 nt, Artificial Sequence
  Synthetic Oligonucleotide
ggucuggggcaaaugaugaag

SEQ ID NO: 8868 - RNA, 21 nt, Artificial Sequence
  Synthetic Oligonucleotide
cucaauugaagaaguggcgga

SEQ ID NO: 8869 - RNA, 21 nt, Artificial Sequence
  Synthetic Oligonucleotide
gcaggcuaaagugcuguaucc

SEQ ID NO: 8870 - RNA, 21 nt, Artificial Sequence
  Synthetic Oligonucleotide
cagcugggaagauaucaaaug

SEQ ID NO: 8871 - RNA, 21 nt, Artificial Sequence
  Synthetic Oligonucleotide
aagcuguauccaaggaugcuc

SEQ ID NO: 8872 - RNA, 21 nt, Artificial Sequence
  Synthetic Oligonucleotide
cgagcuugccacugugagagc

SEQ ID NO: 8873 - RNA, 21 nt, Artificial Sequence
  Synthetic Oligonucleotide
cccugggaacgggcaugaugu

SEQ ID NO: 8874 - RNA, 21 nt, Artificial Sequence
  Synthetic Oligonucleotide
uuggaauggguggcgguaauu

SEQ ID NO: 8875 - RNA, 21 nt, Artificial Sequence
  Synthetic Oligonucleotide
aggugaugaugccagggaggc

SEQ ID NO: 8876 - RNA, 21 nt, Artificial Sequence
  Synthetic Oligonucleotide
guguuuagacaacgucauccc

SEQ ID NO: 8877 - RNA, 21 nt, Artificial Sequence
  Synthetic Oligonucleotide
auuuuggagacgacaguggac

SEQ ID NO: 8878 - RNA, 21 nt, Artificial Sequence
  Synthetic Oligonucleotide
ggcauuuugagaggugaugau

SEQ ID NO: 8879 - RNA, 21 nt, Artificial Sequence
  Synthetic Oligonucleotide
aagaugggcuacaaggccaua

SEQ ID NO: 8880 - RNA, 21 nt, Artificial Sequence
  Synthetic Oligonucleotide
gauacuaaaggaagaauuccg

SEQ ID NO: 8881 - RNA, 21 nt, Artificial Sequence
  Synthetic Oligonucleotide
auuuugagaggugaugaugcc

SEQ ID NO: 8882 - RNA, 21 nt, Artificial Sequence
  Synthetic Oligonucleotide
aggcacugauguucugaaagc

SEQ ID NO: 8883 - RNA, 21 nt, Artificial Sequence
  Synthetic Oligonucleotide
cagggaggcuguuaaacaugg

SEQ ID NO: 8884 - RNA, 21 nt, Artificial Sequence
  Synthetic Oligonucleotide
cuucuguuuuaggacagaggg

SEQ ID NO: 8885 - RNA, 21 nt, Artificial Sequence
  Synthetic Oligonucleotide
guaacagauucaaacugccgc

SEQ ID NO: 8886 - RNA, 21 nt, Artificial Sequence
  Synthetic Oligonucleotide
cugccagaaauuguggaggcu

SEQ ID NO: 8887 - RNA, 21 nt, Artificial Sequence
  Synthetic Oligonucleotide
ggcaaccgucuggaugaugug

SEQ ID NO: 8888 - RNA, 21 nt, Artificial Sequence
  Synthetic Oligonucleotide
agagaagaugggcuacaaggc

SEQ ID NO: 8889 - RNA, 21 nt, Artificial Sequence
  Synthetic Oligonucleotide
auagacccaucuaucagcugg

SEQ ID NO: 8890 - RNA, 21 nt, Artificial Sequence
  Synthetic Oligonucleotide
uggcucugagugggugccaga

SEQ ID NO: 8891 - RNA, 21 nt, Artificial Sequence
  Synthetic Oligonucleotide
gccguuuccaagaucugacag

SEQ ID NO: 8892 - RNA, 21 nt, Artificial Sequence
  Synthetic Oligonucleotide
ggggugugcggaaaggcacug

SEQ ID NO: 8893 - RNA, 21 nt, Artificial Sequence
  Synthetic Oligonucleotide
ucaauugaagaaguggcggaa

SEQ ID NO: 8894 - RNA, 21 nt, Artificial Sequence
  Synthetic Oligonucleotide
ccugggccaccuccucaauug

SEQ ID NO: 8895 - RNA, 21 nt, Artificial Sequence
  Synthetic Oligonucleotide
accuccucaauugaagaagug

SEQ ID NO: 8896 - RNA, 21 nt, Artificial Sequence
  Synthetic Oligonucleotide
cuguuaaacauggcuugaaug

SEQ ID NO: 8897 - RNA, 21 nt, Artificial Sequence
  Synthetic Oligonucleotide
uggccguuuccaagaucugac

SEQ ID NO: 8898 - RNA, 21 nt, Artificial Sequence
  Synthetic Oligonucleotide
uccucaauugaagaaguggcg

SEQ ID NO: 8899 - RNA, 21 nt, Artificial Sequence
  Synthetic Oligonucleotide
uauauaugacuauuacagguc

SEQ ID NO: 8900 - RNA, 21 nt, Artificial Sequence
  Synthetic Oligonucleotide
ggcacuucguuggcugcaacu

SEQ ID NO: 8901 - RNA, 21 nt, Artificial Sequence
  Synthetic Oligonucleotide
uuccugggccaccuccucaau

SEQ ID NO: 8902 - RNA, 21 nt, Artificial Sequence
  Synthetic Oligonucleotide
agcuguauccaaggaugcucc

SEQ ID NO: 8903 - RNA, 21 nt, Artificial Sequence
  Synthetic Oligonucleotide
uaaacauggcuugaaugggau

SEQ ID NO: 8904 - RNA, 21 nt, Artificial Sequence
  Synthetic Oligonucleotide
acacugugcagagggugacca

SEQ ID NO: 8905 - RNA, 21 nt, Artificial Sequence
  Synthetic Oligonucleotide
gaggaaaaauccuuuggccgu

SEQ ID NO: 8906 - RNA, 21 nt, Artificial Sequence
  Synthetic Oligonucleotide
gagagaauuggaauggguggc

SEQ ID NO: 8907 - RNA, 21 nt, Artificial Sequence
  Synthetic Oligonucleotide
ugaagaaguggcggaagcugg

SEQ ID NO: 8908 - RNA, 21 nt, Artificial Sequence
  Synthetic Oligonucleotide
auuccccacuucaauacaaag

SEQ ID NO: 8909 - RNA, 21 nt, Artificial Sequence
  Synthetic Oligonucleotide
auacuaaaggaagaauuccgg

SEQ ID NO: 8910 - RNA, 21 nt, Artificial Sequence
  Synthetic Oligonucleotide
uguggaagggaagguggaagu

SEQ ID NO: 8911 - RNA, 21 nt, Artificial Sequence
  Synthetic Oligonucleotide
uaugacuauuacaggucuggg

SEQ ID NO: 8912 - RNA, 21 nt, Artificial Sequence
  Synthetic Oligonucleotide
ugccacugugagagccuguca

SEQ ID NO: 8913 - RNA, 21 nt, Artificial Sequence
  Synthetic Oligonucleotide
auuggaauggguggcgguaau

SEQ ID NO: 8914 - RNA, 21 nt, Artificial Sequence
  Synthetic Oligonucleotide
ccucaauugaagaaguggcgg

SEQ ID NO: 8915 - RNA, 21 nt, Artificial Sequence
  Synthetic Oligonucleotide
caacucgauggggugccagcc

SEQ ID NO: 8916 - RNA, 21 nt, Artificial Sequence
  Synthetic Oligonucleotide
caccuccucaauugaagaagu

SEQ ID NO: 8917 - RNA, 21 nt, Artificial Sequence
  Synthetic Oligonucleotide
agaauuggaauggguggcggu

SEQ ID NO: 8918 - RNA, 21 nt, Artificial Sequence
  Synthetic Oligonucleotide
aggaaaaauccuuuggccguu

SEQ ID NO: 8919 - RNA, 21 nt, Artificial Sequence
  Synthetic Oligonucleotide
ggaagggaagguggaagucuu

SEQ ID NO: 8920 - RNA, 21 nt, Artificial Sequence
  Synthetic Oligonucleotide
aucagcugggaagauaucaaa

SEQ ID NO: 8921 - RNA, 21 nt, Artificial Sequence
  Synthetic Oligonucleotide
cuccucaauugaagaaguggc

SEQ ID NO: 8922 - RNA, 21 nt, Artificial Sequence
  Synthetic Oligonucleotide
cgacuucuguuuuaggacaga

SEQ ID NO: 8923 - RNA, 21 nt, Artificial Sequence
  Synthetic Oligonucleotide
agcacuggagagaauuggaau

SEQ ID NO: 8924 - RNA, 21 nt, Artificial Sequence
  Synthetic Oligonucleotide
accaaucguuuggggcuuagc

SEQ ID NO: 8925 - RNA, 21 nt, Artificial Sequence
  Synthetic Oligonucleotide
gggccaccuccucaauugaag

SEQ ID NO: 8926 - RNA, 21 nt, Artificial Sequence
  Synthetic Oligonucleotide
gcuguuaaacauggcuugaau

SEQ ID NO: 8927 - RNA, 21 nt, Artificial Sequence
  Synthetic Oligonucleotide
acugauguucugaaagcucug

SEQ ID NO: 8928 - RNA, 21 nt, Artificial Sequence
  Synthetic Oligonucleotide
gugcguaacagauucaaacug

SEQ ID NO: 8929 - RNA, 21 nt, Artificial Sequence
  Synthetic Oligonucleotide
gauucaaacugccgccacaac

SEQ ID NO: 8930 - RNA, 21 nt, Artificial Sequence
  Synthetic Oligonucleotide
aauuggaauggguggcgguaa

SEQ ID NO: 8931 - RNA, 21 nt, Artificial Sequence
  Synthetic Oligonucleotide
ugaggaaaaauccuuuggccg

SEQ ID NO: 8932 - RNA, 21 nt, Artificial Sequence
  Synthetic Oligonucleotide
cuggcaggcuaaagugcugua

SEQ ID NO: 8933 - RNA, 21 nt, Artificial Sequence
  Synthetic Oligonucleotide
gaugaugccagggaggcuguu

SEQ ID NO: 8934 - RNA, 21 nt, Artificial Sequence
  Synthetic Oligonucleotide
cuugccacugugagagccugu

SEQ ID NO: 8935 - RNA, 21 nt, Artificial Sequence
  Synthetic Oligonucleotide
gcauuuugagaggugaugaug

SEQ ID NO: 8936 - RNA, 21 nt, Artificial Sequence
  Synthetic Oligonucleotide
aguuccugggccaccuccuca

SEQ ID NO: 8937 - RNA, 21 nt, Artificial Sequence
  Synthetic Oligonucleotide
auauaugacuauuacaggucu

SEQ ID NO: 8938 - RNA, 21 nt, Artificial Sequence
  Synthetic Oligonucleotide
gacaguggacuugcugcauau

SEQ ID NO: 8939 - RNA, 21 nt, Artificial Sequence
  Synthetic Oligonucleotide
uguuuagacaacgucaucccc

SEQ ID NO: 8940 - RNA, 21 nt, Artificial Sequence
  Synthetic Oligonucleotide
uguucugccagaaauugugga

SEQ ID NO: 8941 - RNA, 21 nt, Artificial Sequence
  Synthetic Oligonucleotide
aacucgauggggugccagcca

SEQ ID NO: 8942 - RNA, 21 nt, Artificial Sequence
  Synthetic Oligonucleotide
gagaagucaccaagaagcuag

SEQ ID NO: 8943 - RNA, 21 nt, Artificial Sequence
  Synthetic Oligonucleotide
ggugugcggaaaggcacugau

SEQ ID NO: 8944 - RNA, 21 nt, Artificial Sequence
  Synthetic Oligonucleotide
ggaggcuguuaaacauggcuu

SEQ ID NO: 8945 - RNA, 21 nt, Artificial Sequence
  Synthetic Oligonucleotide
uuguggaggcuguggaaggga

SEQ ID NO: 8946 - RNA, 21 nt, Artificial Sequence
  Synthetic Oligonucleotide
cuuggugucgaaucauggggc

SEQ ID NO: 8947 - RNA, 21 nt, Artificial Sequence
  Synthetic Oligonucleotide
auucaaacugccgccacaacu

SEQ ID NO: 8948 - RNA, 21 nt, Artificial Sequence
  Synthetic Oligonucleotide
gugaugaugccagggaggcug

SEQ ID NO: 8949 - RNA, 21 nt, Artificial Sequence
  Synthetic Oligonucleotide
auaugacuauuacaggucugg

SEQ ID NO: 8950 - RNA, 21 nt, Artificial Sequence
  Synthetic Oligonucleotide
ucgacaacucgauggggugcc

SEQ ID NO: 8951 - RNA, 21 nt, Artificial Sequence
  Synthetic Oligonucleotide
uuggugaggaaaaauccuuug

SEQ ID NO: 8952 - RNA, 21 nt, Artificial Sequence
  Synthetic Oligonucleotide
cuaaaggaagaauuccgguug

SEQ ID NO: 8953 - RNA, 21 nt, Artificial Sequence
  Synthetic Oligonucleotide
gcguaacagauucaaacugcc

SEQ ID NO: 8954 - RNA, 21 nt, Artificial Sequence
  Synthetic Oligonucleotide
gcuugccacugugagagccug

SEQ ID NO: 8955 - RNA, 21 nt, Artificial Sequence
  Synthetic Oligonucleotide
ccugggaacgggcaugauguu

SEQ ID NO: 8956 - RNA, 21 nt, Artificial Sequence
  Synthetic Oligonucleotide
ucugccagaaauuguggaggc

SEQ ID NO: 8957 - RNA, 21 nt, Artificial Sequence
  Synthetic Oligonucleotide
uauaugacuauuacaggucug

SEQ ID NO: 8958 - RNA, 21 nt, Artificial Sequence
  Synthetic Oligonucleotide
gaacgggcaugauguugaguu

SEQ ID NO: 8959 - RNA, 21 nt, Artificial Sequence
  Synthetic Oligonucleotide
gaggcuguuaaacauggcuug

SEQ ID NO: 8960 - RNA, 21 nt, Artificial Sequence
  Synthetic Oligonucleotide
ggcacugauguucugaaagcu

SEQ ID NO: 8961 - RNA, 21 nt, Artificial Sequence
  Synthetic Oligonucleotide
augggaucuuggugucgaauc

SEQ ID NO: 8962 - RNA, 21 nt, Artificial Sequence
  Synthetic Oligonucleotide
agaccaaucguuuggggcuua

SEQ ID NO: 8963 - RNA, 21 nt, Artificial Sequence
  Synthetic Oligonucleotide
uagacaacgucauccccuggc

SEQ ID NO: 8964 - RNA, 21 nt, Artificial Sequence
  Synthetic Oligonucleotide
acugugcagagggugaccaca

SEQ ID NO: 8965 - RNA, 21 nt, Artificial Sequence
  Synthetic Oligonucleotide
acucgauggggugccagccac

SEQ ID NO: 8966 - RNA, 21 nt, Artificial Sequence
  Synthetic Oligonucleotide
uuaccugggcaaccgucugga

SEQ ID NO: 8967 - RNA, 21 nt, Artificial Sequence
  Synthetic Oligonucleotide
uggaagcuguauccaaggaug

SEQ ID NO: 8968 - RNA, 21 nt, Artificial Sequence
  Synthetic Oligonucleotide
uggugucgaaucauggggcuc

SEQ ID NO: 8969 - RNA, 21 nt, Artificial Sequence
  Synthetic Oligonucleotide
augacuauuacaggucugggg

SEQ ID NO: 8970 - RNA, 21 nt, Artificial Sequence
  Synthetic Oligonucleotide
uaccugggcaaccgucuggau

SEQ ID NO: 8971 - RNA, 21 nt, Artificial Sequence
  Synthetic Oligonucleotide
gugucgaaucauggggcucga

SEQ ID NO: 8972 - RNA, 21 nt, Artificial Sequence
  Synthetic Oligonucleotide
ggccaccuccucaauugaaga

SEQ ID NO: 8973 - RNA, 21 nt, Artificial Sequence
  Synthetic Oligonucleotide
gaggcuguggaagggaaggug

SEQ ID NO: 8974 - RNA, 21 nt, Artificial Sequence
  Synthetic Oligonucleotide
guuuuaggacagagggucagc

SEQ ID NO: 8975 - RNA, 21 nt, Artificial Sequence
  Synthetic Oligonucleotide
ggaaaaauccuuuggccguuu

SEQ ID NO: 8976 - RNA, 21 nt, Artificial Sequence
  Synthetic Oligonucleotide
cugauguucugaaagcucugg

SEQ ID NO: 8977 - RNA, 21 nt, Artificial Sequence
  Synthetic Oligonucleotide
gacuucuguuuuaggacagag

SEQ ID NO: 8978 - RNA, 21 nt, Artificial Sequence
  Synthetic Oligonucleotide
aagggaagguggaagucuucc

SEQ ID NO: 8979 - RNA, 21 nt, Artificial Sequence
  Synthetic Oligonucleotide
uuucuccugaggaaaauuuug

SEQ ID NO: 8980 - RNA, 21 nt, Artificial Sequence
  Synthetic Oligonucleotide
caagaagcuagugcggcaggc

SEQ ID NO: 8981 - RNA, 21 nt, Artificial Sequence
  Synthetic Oligonucleotide
gcuguggaagggaagguggaa

SEQ ID NO: 8982 - RNA, 21 nt, Artificial Sequence
  Synthetic Oligonucleotide
cugaggcacuucguuggcugc

SEQ ID NO: 8983 - RNA, 21 nt, Artificial Sequence
  Synthetic Oligonucleotide
ugugcguaacagauucaaacu

SEQ ID NO: 8984 - RNA, 21 nt, Artificial Sequence
  Synthetic Oligonucleotide
uccuuuggccguuuccaagau

SEQ ID NO: 8985 - RNA, 21 nt, Artificial Sequence
  Synthetic Oligonucleotide
ugucgaaucauggggcucgac

SEQ ID NO: 8986 - RNA, 21 nt, Artificial Sequence
  Synthetic Oligonucleotide
uuuggccguuuccaagaucug

SEQ ID NO: 8987 - RNA, 21 nt, Artificial Sequence
  Synthetic Oligonucleotide
aacgucauccccuggcaggcu

SEQ ID NO: 8988 - RNA, 21 nt, Artificial Sequence
  Synthetic Oligonucleotide
uggugaggaaaaauccuuugg

SEQ ID NO: 8989 - RNA, 21 nt, Artificial Sequence
  Synthetic Oligonucleotide
ggugaugaugccagggaggcu

SEQ ID NO: 8990 - RNA, 21 nt, Artificial Sequence
  Synthetic Oligonucleotide
acuaaaggaagaauuccgguu

SEQ ID NO: 8991 - RNA, 21 nt, Artificial Sequence
  Synthetic Oligonucleotide
acuucuguuuuaggacagagg

SEQ ID NO: 8992 - RNA, 21 nt, Artificial Sequence
  Synthetic Oligonucleotide
ccuuuggccguuuccaagauc

SEQ ID NO: 8993 - RNA, 21 nt, Artificial Sequence
  Synthetic Oligonucleotide
ccaccuccucaauugaagaag

SEQ ID NO: 8994 - RNA, 21 nt, Artificial Sequence
  Synthetic Oligonucleotide
auccuuuggccguuuccaaga

SEQ ID NO: 8995 - RNA, 21 nt, Artificial Sequence
  Synthetic Oligonucleotide
ggugucgaaucauggggcucg

SEQ ID NO: 8996 - RNA, 21 nt, Artificial Sequence
  Synthetic Oligonucleotide
ggaggcuguggaagggaaggu

SEQ ID NO: 8997 - RNA, 21 nt, Artificial Sequence
  Synthetic Oligonucleotide
auuguggaggcuguggaaggg

SEQ ID NO: 8998 - RNA, 21 nt, Artificial Sequence
  Synthetic Oligonucleotide
ccaaucguuuggggcuuagcu

SEQ ID NO: 8999 - RNA, 21 nt, Artificial Sequence
  Synthetic Oligonucleotide
gccagaaauuguggaggcugu

SEQ ID NO: 9000 - RNA, 21 nt, Artificial Sequence
  Synthetic Oligonucleotide
accugggcaaccgucuggaug

SEQ ID NO: 9001 - RNA, 21 nt, Artificial Sequence
  Synthetic Oligonucleotide
cggaagcugguccugaggcac

SEQ ID NO: 9002 - RNA, 21 nt, Artificial Sequence
  Synthetic Oligonucleotide
aaacauggcuugaaugggauc

SEQ ID NO: 9003 - RNA, 21 nt, Artificial Sequence
  Synthetic Oligonucleotide
gaggcacuucguuggcugcaa

SEQ ID NO: 9004 - RNA, 21 nt, Artificial Sequence
  Synthetic Oligonucleotide
cugugagagccugucaguccc

SEQ ID NO: 9005 - RNA, 21 nt, Artificial Sequence
  Synthetic Oligonucleotide
ugaugccagggaggcuguuaa

SEQ ID NO: 9006 - RNA, 21 nt, Artificial Sequence
  Synthetic Oligonucleotide
cauuggugaggaaaaauccuu

SEQ ID NO: 9007 - RNA, 21 nt, Artificial Sequence
  Synthetic Oligonucleotide
gccacugugagagccugucag

SEQ ID NO: 9008 - RNA, 21 nt, Artificial Sequence
  Synthetic Oligonucleotide
uggacggcgagcuugccacug

SEQ ID NO: 9009 - RNA, 21 nt, Artificial Sequence
  Synthetic Oligonucleotide
ggaagcugguccugaggcacu

SEQ ID NO: 9010 - RNA, 21 nt, Artificial Sequence
  Synthetic Oligonucleotide
ucccugggaacgggcaugaug

SEQ ID NO: 9011 - RNA, 21 nt, Artificial Sequence
  Synthetic Oligonucleotide
aaugggaucuuggugucgaau

SEQ ID NO: 9012 - RNA, 21 nt, Artificial Sequence
  Synthetic Oligonucleotide
gaguuccugggccaccuccuc

SEQ ID NO: 9013 - RNA, 21 nt, Artificial Sequence
  Synthetic Oligonucleotide
gaaaaauccuuuggccguuuc

SEQ ID NO: 9014 - RNA, 21 nt, Artificial Sequence
  Synthetic Oligonucleotide
gaagggaagguggaagucuuc

SEQ ID NO: 9015 - RNA, 21 nt, Artificial Sequence
  Synthetic Oligonucleotide
uugaguuccugggccaccucc

SEQ ID NO: 9016 - RNA, 21 nt, Artificial Sequence
  Synthetic Oligonucleotide
caauugaagaaguggcggaag

SEQ ID NO: 9017 - RNA, 21 nt, Artificial Sequence
  Synthetic Oligonucleotide
caaucguuuggggcuuagcuu

SEQ ID NO: 9018 - RNA, 21 nt, Artificial Sequence
  Synthetic Oligonucleotide
cuuuggccguuuccaagaucu

SEQ ID NO: 9019 - RNA, 21 nt, Artificial Sequence
  Synthetic Oligonucleotide
aaggaagaauuccgguuggcc

SEQ ID NO: 9020 - RNA, 21 nt, Artificial Sequence
  Synthetic Oligonucleotide
ccagggaggcuguuaaacaug

SEQ ID NO: 9021 - RNA, 21 nt, Artificial Sequence
  Synthetic Oligonucleotide
guguuuguggggagaccaauc

SEQ ID NO: 9022 - RNA, 21 nt, Artificial Sequence
  Synthetic Oligonucleotide
ccagaaauuguggaggcugug

SEQ ID NO: 9023 - RNA, 21 nt, Artificial Sequence
  Synthetic Oligonucleotide
ggcaggcuaaagugcuguauc

SEQ ID NO: 9024 - RNA, 21 nt, Artificial Sequence
  Synthetic Oligonucleotide
cagagaagaugggcuacaagg

SEQ ID NO: 9025 - RNA, 21 nt, Artificial Sequence
  Synthetic Oligonucleotide
agaagucaccaagaagcuagu

SEQ ID NO: 9026 - RNA, 21 nt, Artificial Sequence
  Synthetic Oligonucleotide
auguggacggcgagcuugcca

SEQ ID NO: 9027 - RNA, 21 nt, Artificial Sequence
  Synthetic Oligonucleotide
ccacugugagagccugucagu

SEQ ID NO: 9028 - RNA, 21 nt, Artificial Sequence
  Synthetic Oligonucleotide
acuuuucaauggguguccuag

SEQ ID NO: 9029 - RNA, 21 nt, Artificial Sequence
  Synthetic Oligonucleotide
gcuguauccaaggaugcuccg

SEQ ID NO: 9030 - RNA, 21 nt, Artificial Sequence
  Synthetic Oligonucleotide
auguugaguuccugggccacc

SEQ ID NO: 9031 - RNA, 21 nt, Artificial Sequence
  Synthetic Oligonucleotide
aaaaauccuuuggccguuucc

SEQ ID NO: 9032 - RNA, 21 nt, Artificial Sequence
  Synthetic Oligonucleotide
ccuggcaggcuaaagugcugu

SEQ ID NO: 9033 - RNA, 21 nt, Artificial Sequence
  Synthetic Oligonucleotide
aaaauccuuuggccguuucca

SEQ ID NO: 9034 - RNA, 21 nt, Artificial Sequence
  Synthetic Oligonucleotide
gaaauuguggaggcuguggaa

SEQ ID NO: 9035 - RNA, 21 nt, Artificial Sequence
  Synthetic Oligonucleotide
cuggagagaauuggaaugggu

SEQ ID NO: 9036 - RNA, 21 nt, Artificial Sequence
  Synthetic Oligonucleotide
augauguugaguuccugggcc

SEQ ID NO: 9037 - RNA, 21 nt, Artificial Sequence
  Synthetic Oligonucleotide
gauguucugccagaaauugug

SEQ ID NO: 9038 - RNA, 21 nt, Artificial Sequence
  Synthetic Oligonucleotide
agaagcuagugcggcaggcag

SEQ ID NO: 9039 - RNA, 21 nt, Artificial Sequence
  Synthetic Oligonucleotide
ucgaaucauggggcucgacaa

SEQ ID NO: 9040 - RNA, 21 nt, Artificial Sequence
  Synthetic Oligonucleotide
ugccagggaggcuguuaaaca

SEQ ID NO: 9041 - RNA, 21 nt, Artificial Sequence
  Synthetic Oligonucleotide
cacuggagagaauuggaaugg

SEQ ID NO: 9042 - RNA, 21 nt, Artificial Sequence
  Synthetic Oligonucleotide
gcagagaagaugggcuacaag

SEQ ID NO: 9043 - RNA, 21 nt, Artificial Sequence
  Synthetic Oligonucleotide
ggagaccaaucguuuggggcu

SEQ ID NO: 9044 - RNA, 21 nt, Artificial Sequence
  Synthetic Oligonucleotide
aauuguggaggcuguggaagg

SEQ ID NO: 9045 - RNA, 21 nt, Artificial Sequence
  Synthetic Oligonucleotide
cgaaucauggggcucgacaac

SEQ ID NO: 9046 - RNA, 21 nt, Artificial Sequence
  Synthetic Oligonucleotide
guccugaggcacuucguuggc

SEQ ID NO: 9047 - RNA, 21 nt, Artificial Sequence
  Synthetic Oligonucleotide
agucccugggaacgggcauga

SEQ ID NO: 9048 - RNA, 21 nt, Artificial Sequence
  Synthetic Oligonucleotide
acugugagagccugucagucc

SEQ ID NO: 9049 - RNA, 21 nt, Artificial Sequence
  Synthetic Oligonucleotide
uggagagaauuggaaugggug

SEQ ID NO: 9050 - RNA, 21 nt, Artificial Sequence
  Synthetic Oligonucleotide
auggcucugagugggugccag

SEQ ID NO: 9051 - RNA, 21 nt, Artificial Sequence
  Synthetic Oligonucleotide
gaagucaccaagaagcuagug

SEQ ID NO: 9052 - RNA, 21 nt, Artificial Sequence
  Synthetic Oligonucleotide
uaaaggaagaauuccgguugg

SEQ ID NO: 9053 - RNA, 21 nt, Artificial Sequence
  Synthetic Oligonucleotide
uuggccguuuccaagaucuga

SEQ ID NO: 9054 - RNA, 21 nt, Artificial Sequence
  Synthetic Oligonucleotide
aauccuuuggccguuuccaag

SEQ ID NO: 9055 - RNA, 21 nt, Artificial Sequence
  Synthetic Oligonucleotide
cggcaggcagagaagaugggc

SEQ ID NO: 9056 - RNA, 21 nt, Artificial Sequence
  Synthetic Oligonucleotide
ugugagagccugucagucccu

SEQ ID NO: 9057 - RNA, 21 nt, Artificial Sequence
  Synthetic Oligonucleotide
guucugccagaaauuguggag

SEQ ID NO: 9058 - RNA, 21 nt, Artificial Sequence
  Synthetic Oligonucleotide
aagaagcuagugcggcaggca

SEQ ID NO: 9059 - RNA, 21 nt, Artificial Sequence
  Synthetic Oligonucleotide
agauucaaacugccgccacaa

SEQ ID NO: 9060 - RNA, 21 nt, Artificial Sequence
  Synthetic Oligonucleotide
uguuuguggggagaccaaucg

SEQ ID NO: 9061 - RNA, 21 nt, Artificial Sequence
  Synthetic Oligonucleotide
uguuuuaggacagagggucag

SEQ ID NO: 9062 - RNA, 21 nt, Artificial Sequence
  Synthetic Oligonucleotide
agggaagguggaagucuuccu

SEQ ID NO: 9063 - RNA, 21 nt, Artificial Sequence
  Synthetic Oligonucleotide
auuggugaggaaaaauccuuu

SEQ ID NO: 9064 - RNA, 21 nt, Artificial Sequence
  Synthetic Oligonucleotide
agacaacgucauccccuggca

SEQ ID NO: 9065 - RNA, 21 nt, Artificial Sequence
  Synthetic Oligonucleotide
guuuagacaacgucauccccu

SEQ ID NO: 9066 - RNA, 21 nt, Artificial Sequence
  Synthetic Oligonucleotide
ggugaggaaaaauccuuuggc

SEQ ID NO: 9067 - RNA, 21 nt, Artificial Sequence
  Synthetic Oligonucleotide
ggcaggcagagaagaugggcu

SEQ ID NO: 9068 - RNA, 21 nt, Artificial Sequence
  Synthetic Oligonucleotide
gccaccuccucaauugaagaa

SEQ ID NO: 9069 - RNA, 21 nt, Artificial Sequence
  Synthetic Oligonucleotide
caugauguugaguuccugggc

SEQ ID NO: 9070 - RNA, 21 nt, Artificial Sequence
  Synthetic Oligonucleotide
ggagagaauuggaaugggugg

SEQ ID NO: 9071 - RNA, 21 nt, Artificial Sequence
  Synthetic Oligonucleotide
ccuccucaauugaagaagugg

SEQ ID NO: 9072 - RNA, 21 nt, Artificial Sequence
  Synthetic Oligonucleotide
acuggagagaauuggaauggg

SEQ ID NO: 9073 - RNA, 21 nt, Artificial Sequence
  Synthetic Oligonucleotide
uccccuggcaggcuaaagugc

SEQ ID NO: 9074 - RNA, 21 nt, Artificial Sequence
  Synthetic Oligonucleotide
uggaggcuguggaagggaagg

SEQ ID NO: 9075 - RNA, 21 nt, Artificial Sequence
  Synthetic Oligonucleotide
cauggcucugagugggugcca

SEQ ID NO: 9076 - RNA, 21 nt, Artificial Sequence
  Synthetic Oligonucleotide
aagucaccaagaagcuagugc

SEQ ID NO: 9077 - RNA, 21 nt, Artificial Sequence
  Synthetic Oligonucleotide
uugaagaaguggcggaagcug

SEQ ID NO: 9078 - RNA, 21 nt, Artificial Sequence
  Synthetic Oligonucleotide
ugaguuccugggccaccuccu

SEQ ID NO: 9079 - RNA, 21 nt, Artificial Sequence
  Synthetic Oligonucleotide
uccugaggcacuucguuggcu

SEQ ID NO: 9080 - RNA, 21 nt, Artificial Sequence
  Synthetic Oligonucleotide
guuccugggccaccuccucaa

SEQ ID NO: 9081 - RNA, 21 nt, Artificial Sequence
  Synthetic Oligonucleotide
uguggaggcuguggaagggaa

SEQ ID NO: 9082 - RNA, 21 nt, Artificial Sequence
  Synthetic Oligonucleotide
aucuuggugucgaaucauggg

SEQ ID NO: 9083 - RNA, 21 nt, Artificial Sequence
  Synthetic Oligonucleotide
guggaggcuguggaagggaag

SEQ ID NO: 9084 - RNA, 21 nt, Artificial Sequence
  Synthetic Oligonucleotide
ugggaucuuggugucgaauca

SEQ ID NO: 9085 - RNA, 21 nt, Artificial Sequence
  Synthetic Oligonucleotide
gucccugggaacgggcaugau

SEQ ID NO: 9086 - RNA, 21 nt, Artificial Sequence
  Synthetic Oligonucleotide
uuuugagaggugaugaugcca

SEQ ID NO: 9087 - RNA, 21 nt, Artificial Sequence
  Synthetic Oligonucleotide
cauggcuugaaugggaucuug

SEQ ID NO: 9088 - RNA, 21 nt, Artificial Sequence
  Synthetic Oligonucleotide
ccauggcucugagugggugcc

SEQ ID NO: 9089 - RNA, 21 nt, Artificial Sequence
  Synthetic Oligonucleotide
gagaggugaugaugccaggga

SEQ ID NO: 9090 - RNA, 21 nt, Artificial Sequence
  Synthetic Oligonucleotide
gcgagcuugccacugugagag

SEQ ID NO: 9091 - RNA, 21 nt, Artificial Sequence
  Synthetic Oligonucleotide
uguugaguuccugggccaccu

SEQ ID NO: 9092 - RNA, 21 nt, Artificial Sequence
  Synthetic Oligonucleotide
cggcgagcuugccacugugag

SEQ ID NO: 9093 - RNA, 21 nt, Artificial Sequence
  Synthetic Oligonucleotide
cauguggacggcgagcuugcc

SEQ ID NO: 9094 - RNA, 21 nt, Artificial Sequence
  Synthetic Oligonucleotide
aaauuguggaggcuguggaag

SEQ ID NO: 9095 - RNA, 21 nt, Artificial Sequence
  Synthetic Oligonucleotide
aauugaagaaguggcggaagc

SEQ ID NO: 9096 - RNA, 21 nt, Artificial Sequence
  Synthetic Oligonucleotide
gacaacucgauggggugccag

SEQ ID NO: 9097 - RNA, 21 nt, Artificial Sequence
  Synthetic Oligonucleotide
aggaagaauuccgguuggcca

SEQ ID NO: 9098 - RNA, 21 nt, Artificial Sequence
  Synthetic Oligonucleotide
aggcagagaagaugggcuaca

SEQ ID NO: 9099 - RNA, 21 nt, Artificial Sequence
  Synthetic Oligonucleotide
gaccaaucguuuggggcuuag

SEQ ID NO: 9100 - RNA, 21 nt, Artificial Sequence
  Synthetic Oligonucleotide
gugaggaaaaauccuuuggcc

SEQ ID NO: 9101 - RNA, 21 nt, Artificial Sequence
  Synthetic Oligonucleotide
caacgucauccccuggcaggc

SEQ ID NO: 9102 - RNA, 21 nt, Artificial Sequence
  Synthetic Oligonucleotide
cacugugagagccugucaguc

SEQ ID NO: 9103 - RNA, 21 nt, Artificial Sequence
  Synthetic Oligonucleotide
acgucauccccuggcaggcua

SEQ ID NO: 9104 - RNA, 21 nt, Artificial Sequence
  Synthetic Oligonucleotide
gacaacgucauccccuggcag

SEQ ID NO: 9105 - RNA, 21 nt, Artificial Sequence
  Synthetic Oligonucleotide
gaaucauggggcucgacaacu

SEQ ID NO: 9106 - RNA, 21 nt, Artificial Sequence
  Synthetic Oligonucleotide
aaauccuuuggccguuuccaa

SEQ ID NO: 9107 - RNA, 21 nt, Artificial Sequence
  Synthetic Oligonucleotide
ccccuggcaggcuaaagugcu

SEQ ID NO: 9108 - RNA, 21 nt, Artificial Sequence
  Synthetic Oligonucleotide
ucuuggugucgaaucaugggg

SEQ ID NO: 9109 - RNA, 21 nt, Artificial Sequence
  Synthetic Oligonucleotide
ucauguggacggcgagcuugc

SEQ ID NO: 9110 - RNA, 21 nt, Artificial Sequence
  Synthetic Oligonucleotide
aagaauuccgguuggccaugg

SEQ ID NO: 9111 - RNA, 21 nt, Artificial Sequence
  Synthetic Oligonucleotide
ucaccaagaagcuagugcggc

SEQ ID NO: 9112 - RNA, 21 nt, Artificial Sequence
  Synthetic Oligonucleotide
ggaagguggaagucuuccugg

SEQ ID NO: 9113 - RNA, 21 nt, Artificial Sequence
  Synthetic Oligonucleotide
ugauguugaguuccugggcca

SEQ ID NO: 9114 - RNA, 21 nt, Artificial Sequence
  Synthetic Oligonucleotide
accuuaccugggcaaccgucu

SEQ ID NO: 9115 - RNA, 21 nt, Artificial Sequence
  Synthetic Oligonucleotide
cgacaacucgauggggugcca

SEQ ID NO: 9116 - RNA, 21 nt, Artificial Sequence
  Synthetic Oligonucleotide
ugagaggugaugaugccaggg

SEQ ID NO: 9117 - RNA, 21 nt, Artificial Sequence
  Synthetic Oligonucleotide
cugggcaaccgucuggaugau

SEQ ID NO: 9118 - RNA, 21 nt, Artificial Sequence
  Synthetic Oligonucleotide
cccuggcaggcuaaagugcug

SEQ ID NO: 9119 - RNA, 21 nt, Artificial Sequence
  Synthetic Oligonucleotide
ggcgagcuugccacugugaga

SEQ ID NO: 9120 - RNA, 21 nt, Artificial Sequence
  Synthetic Oligonucleotide
gaagaaguggcggaagcuggu

SEQ ID NO: 9121 - RNA, 21 nt, Artificial Sequence
  Synthetic Oligonucleotide
agcuagugcggcaggcagaga

SEQ ID NO: 9122 - RNA, 21 nt, Artificial Sequence
  Synthetic Oligonucleotide
guuuguggggagaccaaucgu

SEQ ID NO: 9123 - RNA, 21 nt, Artificial Sequence
  Synthetic Oligonucleotide
agaauuccgguuggccauggc

SEQ ID NO: 9124 - RNA, 21 nt, Artificial Sequence
  Synthetic Oligonucleotide
gcaugauguugaguuccuggg

SEQ ID NO: 9125 - RNA, 21 nt, Artificial Sequence
  Synthetic Oligonucleotide
gaggugaugaugccagggagg

SEQ ID NO: 9126 - RNA, 21 nt, Artificial Sequence
  Synthetic Oligonucleotide
gaagcuagugcggcaggcaga

SEQ ID NO: 9127 - RNA, 21 nt, Artificial Sequence
  Synthetic Oligonucleotide
acaacucgauggggugccagc

SEQ ID NO: 9128 - RNA, 21 nt, Artificial Sequence
  Synthetic Oligonucleotide
ggacggcgagcuugccacugu

SEQ ID NO: 9129 - RNA, 21 nt, Artificial Sequence
  Synthetic Oligonucleotide
aaaggaagaauuccgguuggc

SEQ ID NO: 9130 - RNA, 21 nt, Artificial Sequence
  Synthetic Oligonucleotide
ggcucgacaacucgauggggu

SEQ ID NO: 9131 - RNA, 21 nt, Artificial Sequence
  Synthetic Oligonucleotide
gcacuggagagaauuggaaug

SEQ ID NO: 9132 - RNA, 21 nt, Artificial Sequence
  Synthetic Oligonucleotide
agaggugaugaugccagggag

SEQ ID NO: 9133 - RNA, 21 nt, Artificial Sequence
  Synthetic Oligonucleotide
uucugccagaaauuguggagg

SEQ ID NO: 9134 - RNA, 21 nt, Artificial Sequence
  Synthetic Oligonucleotide
auugaagaaguggcggaagcu

SEQ ID NO: 9135 - RNA, 21 nt, Artificial Sequence
  Synthetic Oligonucleotide
gggagaccaaucguuuggggc

SEQ ID NO: 9136 - RNA, 21 nt, Artificial Sequence
  Synthetic Oligonucleotide
guggacggcgagcuugccacu

SEQ ID NO: 9137 - RNA, 21 nt, Artificial Sequence
  Synthetic Oligonucleotide
cacaccuuaccugggcaaccg

SEQ ID NO: 9138 - RNA, 21 nt, Artificial Sequence
  Synthetic Oligonucleotide
gggaucuuggugucgaaucau

SEQ ID NO: 9139 - RNA, 21 nt, Artificial Sequence
  Synthetic Oligonucleotide
caccaagaagcuagugcggca

SEQ ID NO: 9140 - RNA, 21 nt, Artificial Sequence
  Synthetic Oligonucleotide
guugaguuccugggccaccuc

SEQ ID NO: 9141 - RNA, 21 nt, Artificial Sequence
  Synthetic Oligonucleotide
ucagucccugggaacgggcau

SEQ ID NO: 9142 - RNA, 21 nt, Artificial Sequence
  Synthetic Oligonucleotide
cucgacaacucgauggggugc

SEQ ID NO: 9143 - RNA, 21 nt, Artificial Sequence
  Synthetic Oligonucleotide
ggaucuuggugucgaaucaug

SEQ ID NO: 9144 - RNA, 21 nt, Artificial Sequence
  Synthetic Oligonucleotide
aagcuagugcggcaggcagag

SEQ ID NO: 9145 - RNA, 21 nt, Artificial Sequence
  Synthetic Oligonucleotide
gacggcgagcuugccacugug

SEQ ID NO: 9146 - RNA, 21 nt, Artificial Sequence
  Synthetic Oligonucleotide
ccugaggcacuucguuggcug

SEQ ID NO: 9147 - RNA, 21 nt, Artificial Sequence
  Synthetic Oligonucleotide
cgggcaugauguugaguuccu

SEQ ID NO: 9148 - RNA, 21 nt, Artificial Sequence
  Synthetic Oligonucleotide
acggcgagcuugccacuguga

SEQ ID NO: 9149 - RNA, 21 nt, Artificial Sequence
  Synthetic Oligonucleotide
gugagagccugucagucccug

SEQ ID NO: 9150 - RNA, 21 nt, Artificial Sequence
  Synthetic Oligonucleotide
ugucagucccugggaacgggc

SEQ ID NO: 9151 - RNA, 21 nt, Artificial Sequence
  Synthetic Oligonucleotide
ggccguuuccaagaucugaca

SEQ ID NO: 9152 - RNA, 21 nt, Artificial Sequence
  Synthetic Oligonucleotide
ggcagagaagaugggcuacaa

SEQ ID NO: 9153 - RNA, 21 nt, Artificial Sequence
  Synthetic Oligonucleotide
aacgggcaugauguugaguuc

SEQ ID NO: 9154 - RNA, 21 nt, Artificial Sequence
  Synthetic Oligonucleotide
cuuaccugggcaaccgucugg

SEQ ID NO: 9155 - RNA, 21 nt, Artificial Sequence
  Synthetic Oligonucleotide
cagucccugggaacgggcaug

SEQ ID NO: 9156 - RNA, 21 nt, Artificial Sequence
  Synthetic Oligonucleotide
gaagcugguccugaggcacuu

SEQ ID NO: 9157 - RNA, 21 nt, Artificial Sequence
  Synthetic Oligonucleotide
gggaagguggaagucuuccug

SEQ ID NO: 9158 - RNA, 21 nt, Artificial Sequence
  Synthetic Oligonucleotide
gucagucccugggaacgggca

SEQ ID NO: 9159 - RNA, 21 nt, Artificial Sequence
  Synthetic Oligonucleotide
ugagagccugucagucccugg

SEQ ID NO: 9160 - RNA, 21 nt, Artificial Sequence
  Synthetic Oligonucleotide
caccuuaccugggcaaccguc

SEQ ID NO: 9161 - RNA, 21 nt, Artificial Sequence
  Synthetic Oligonucleotide
ucauggggcucgacaacucga

SEQ ID NO: 9162 - RNA, 21 nt, Artificial Sequence
  Synthetic Oligonucleotide
ccaugcagcgcauggcucaug

SEQ ID NO: 9163 - RNA, 21 nt, Artificial Sequence
  Synthetic Oligonucleotide
ggggagaccaaucguuugggg

SEQ ID NO: 9164 - RNA, 21 nt, Artificial Sequence
  Synthetic Oligonucleotide
ucauccccuggcaggcuaaag

SEQ ID NO: 9165 - RNA, 21 nt, Artificial Sequence
  Synthetic Oligonucleotide
uuguggggagaccaaucguuu

SEQ ID NO: 9166 - RNA, 21 nt, Artificial Sequence
  Synthetic Oligonucleotide
ccaagaagcuagugcggcagg

SEQ ID NO: 9167 - RNA, 21 nt, Artificial Sequence
  Synthetic Oligonucleotide
acaacgucauccccuggcagg

SEQ ID NO: 9168 - RNA, 21 nt, Artificial Sequence
  Synthetic Oligonucleotide
acgggcaugauguugaguucc

SEQ ID NO: 9169 - RNA, 21 nt, Artificial Sequence
  Synthetic Oligonucleotide
uuugagaggugaugaugccag

SEQ ID NO: 9170 - RNA, 21 nt, Artificial Sequence
  Synthetic Oligonucleotide
auguucugaaagcucuggcuc

SEQ ID NO: 9171 - RNA, 21 nt, Artificial Sequence
  Synthetic Oligonucleotide
uguggacggcgagcuugccac

SEQ ID NO: 9172 - RNA, 21 nt, Artificial Sequence
  Synthetic Oligonucleotide
gccagggaggcuguuaaacau

SEQ ID NO: 9173 - RNA, 21 nt, Artificial Sequence
  Synthetic Oligonucleotide
uuagacaacgucauccccugg

SEQ ID NO: 9174 - RNA, 21 nt, Artificial Sequence
  Synthetic Oligonucleotide
ccugggcaaccgucuggauga

SEQ ID NO: 9175 - RNA, 21 nt, Artificial Sequence
  Synthetic Oligonucleotide
cauccccuggcaggcuaaagu

SEQ ID NO: 9176 - RNA, 27 nt, Artificial Sequence
  Synthetic Oligonucleotide
cuggaaauauauuaacuguuaaaaaga

SEQ ID NO: 9177 - RNA, 27 nt, Artificial Sequence
  Synthetic Oligonucleotide
uaaugaucucauuguuuauuaaccugu

SEQ ID NO: 9178 - RNA, 27 nt, Artificial Sequence
  Synthetic Oligonucleotide
aagauaaugaucucauuguuuauuaac

SEQ ID NO: 9179 - RNA, 27 nt, Artificial Sequence
  Synthetic Oligonucleotide
uggaaauauauuaacuguuaaaaagaa

SEQ ID NO: 9180 - RNA, 27 nt, Artificial Sequence
  Synthetic Oligonucleotide
uucagcauguauuacuugacaaagaga

SEQ ID NO: 9181 - RNA, 27 nt, Artificial Sequence
  Synthetic Oligonucleotide
uccuggaaauauauuaacuguuaaaaa

SEQ ID NO: 9182 - RNA, 27 nt, Artificial Sequence
  Synthetic Oligonucleotide
aaagauaaugaucucauuguuuauuaa

SEQ ID NO: 9183 - RNA, 27 nt, Artificial Sequence
  Synthetic Oligonucleotide
aaauuuugaaaccaguacuuuaucauu

SEQ ID NO: 9184 - RNA, 27 nt, Artificial Sequence
  Synthetic Oligonucleotide
uugaaaccaguacuuuaucauuuucuc

SEQ ID NO: 9185 - RNA, 27 nt, Artificial Sequence
  Synthetic Oligonucleotide
ccuggaaauauauuaacuguuaaaaag

SEQ ID NO: 9186 - RNA, 27 nt, Artificial Sequence
  Synthetic Oligonucleotide
aacaaaauagcaaucccuuuuauuuca

SEQ ID NO: 9187 - RNA, 27 nt, Artificial Sequence
  Synthetic Oligonucleotide
auaaugaucucauuguuuauuaaccug

SEQ ID NO: 9188 - RNA, 27 nt, Artificial Sequence
  Synthetic Oligonucleotide
aacagugguucuuaaauuguaagcuca

SEQ ID NO: 9189 - RNA, 27 nt, Artificial Sequence
  Synthetic Oligonucleotide
ggacuuucauccuggaaauauauuaac

SEQ ID NO: 9190 - RNA, 27 nt, Artificial Sequence
  Synthetic Oligonucleotide
uuaugaacaacaugcuaaaucaguacu

SEQ ID NO: 9191 - RNA, 27 nt, Artificial Sequence
  Synthetic Oligonucleotide
gugaaaagauaaugaucucauuguuua

SEQ ID NO: 9192 - RNA, 27 nt, Artificial Sequence
  Synthetic Oligonucleotide
uggugauacuucuuugaauguagauuu

SEQ ID NO: 9193 - RNA, 27 nt, Artificial Sequence
  Synthetic Oligonucleotide
agaagacugacaucauugccaauuguu

SEQ ID NO: 9194 - RNA, 27 nt, Artificial Sequence
  Synthetic Oligonucleotide
uggacuuucauccuggaaauauauuaa

SEQ ID NO: 9195 - RNA, 27 nt, Artificial Sequence
  Synthetic Oligonucleotide
ucauccuggaaauauauuaacuguuaa

SEQ ID NO: 9196 - RNA, 27 nt, Artificial Sequence
  Synthetic Oligonucleotide
gagaagacugacaucauugccaauugu

SEQ ID NO: 9197 - RNA, 27 nt, Artificial Sequence
  Synthetic Oligonucleotide
aauuggugauacuucuuugaauguaga

SEQ ID NO: 9198 - RNA, 27 nt, Artificial Sequence
  Synthetic Oligonucleotide
cucauuguuuauuaaccuguauucugu

SEQ ID NO: 9199 - RNA, 27 nt, Artificial Sequence
  Synthetic Oligonucleotide
aggugaaaagauaaugaucucauuguu

SEQ ID NO: 9200 - RNA, 27 nt, Artificial Sequence
  Synthetic Oligonucleotide
uuucauccuggaaauauauuaacuguu

SEQ ID NO: 9201 - RNA, 27 nt, Artificial Sequence
  Synthetic Oligonucleotide
acaaaauagcaaucccuuuuauuucau

SEQ ID NO: 9202 - RNA, 27 nt, Artificial Sequence
  Synthetic Oligonucleotide
agauaaugaucucauuguuuauuaacc

SEQ ID NO: 9203 - RNA, 27 nt, Artificial Sequence
  Synthetic Oligonucleotide
cuuucauccuggaaauauauuaacugu

SEQ ID NO: 9204 - RNA, 27 nt, Artificial Sequence
  Synthetic Oligonucleotide
uagcaaucccuuuuauuucauugcuuu

SEQ ID NO: 9205 - RNA, 27 nt, Artificial Sequence
  Synthetic Oligonucleotide
caaaauagcaaucccuuuuauuucauu

SEQ ID NO: 9206 - RNA, 27 nt, Artificial Sequence
  Synthetic Oligonucleotide
ucagcauguauuacuugacaaagagac

SEQ ID NO: 9207 - RNA, 27 nt, Artificial Sequence
  Synthetic Oligonucleotide
guaauuggugauacuucuuugaaugua

SEQ ID NO: 9208 - RNA, 27 nt, Artificial Sequence
  Synthetic Oligonucleotide
gggauagcaauaaccugugaaaaugcu

SEQ ID NO: 9209 - RNA, 27 nt, Artificial Sequence
  Synthetic Oligonucleotide
ucauuguuuauuaaccuguauucuguu

SEQ ID NO: 9210 - RNA, 27 nt, Artificial Sequence
  Synthetic Oligonucleotide
cacaacucaggaugaaaaauuuugaaa

SEQ ID NO: 9211 - RNA, 27 nt, Artificial Sequence
  Synthetic Oligonucleotide
uucauccuggaaauauauuaacuguua

SEQ ID NO: 9212 - RNA, 27 nt, Artificial Sequence
  Synthetic Oligonucleotide
ugggauagcaauaaccugugaaaaugc

SEQ ID NO: 9213 - RNA, 27 nt, Artificial Sequence
  Synthetic Oligonucleotide
uaauuggugauacuucuuugaauguag

SEQ ID NO: 9214 - RNA, 27 nt, Artificial Sequence
  Synthetic Oligonucleotide
augaaaaauuuugaaaccaguacuuua

SEQ ID NO: 9215 - RNA, 27 nt, Artificial Sequence
  Synthetic Oligonucleotide
aauuuguaucaaugauuaugaacaaca

SEQ ID NO: 9216 - RNA, 27 nt, Artificial Sequence
  Synthetic Oligonucleotide
ggcuaauuuguaucaaugauuaugaac

SEQ ID NO: 9217 - RNA, 27 nt, Artificial Sequence
  Synthetic Oligonucleotide
gucugaauauauccaaauguuuuagga

SEQ ID NO: 9218 - RNA, 27 nt, Artificial Sequence
  Synthetic Oligonucleotide
aaacagugguucuuaaauuguaagcuc

SEQ ID NO: 9219 - RNA, 27 nt, Artificial Sequence
  Synthetic Oligonucleotide
ugaucucauuguuuauuaaccuguauu

SEQ ID NO: 9220 - RNA, 27 nt, Artificial Sequence
  Synthetic Oligonucleotide
ucucauuguuuauuaaccuguauucug

SEQ ID NO: 9221 - RNA, 27 nt, Artificial Sequence
  Synthetic Oligonucleotide
uuuuuuucagcauguauuacuugacaa

SEQ ID NO: 9222 - RNA, 27 nt, Artificial Sequence
  Synthetic Oligonucleotide
aaccaguacuuuaucauuuucuccuga

SEQ ID NO: 9223 - RNA, 27 nt, Artificial Sequence
  Synthetic Oligonucleotide
guaaugccugauucacaacuuugagaa

SEQ ID NO: 9224 - RNA, 27 nt, Artificial Sequence
  Synthetic Oligonucleotide
aaaauuuugaaaccaguacuuuaucau

SEQ ID NO: 9225 - RNA, 27 nt, Artificial Sequence
  Synthetic Oligonucleotide
auagcaaucccuuuuauuucauugcuu

SEQ ID NO: 9226 - RNA, 27 nt, Artificial Sequence
  Synthetic Oligonucleotide
cggcuaauuuguaucaaugauuaugaa

SEQ ID NO: 9227 - RNA, 27 nt, Artificial Sequence
  Synthetic Oligonucleotide
auccuggaaauauauuaacuguuaaaa

SEQ ID NO: 9228 - RNA, 27 nt, Artificial Sequence
  Synthetic Oligonucleotide
aaaagauaaugaucucauuguuuauua

SEQ ID NO: 9229 - RNA, 27 nt, Artificial Sequence
  Synthetic Oligonucleotide
cugaauauauccaaauguuuuaggaug

SEQ ID NO: 9230 - RNA, 27 nt, Artificial Sequence
  Synthetic Oligonucleotide
uaauuuguaucaaugauuaugaacaac

SEQ ID NO: 9231 - RNA, 27 nt, Artificial Sequence
  Synthetic Oligonucleotide
acugacaucauugccaauuguugcaaa

SEQ ID NO: 9232 - RNA, 27 nt, Artificial Sequence
  Synthetic Oligonucleotide
aaugauuaugaacaacaugcuaaauca

SEQ ID NO: 9233 - RNA, 27 nt, Artificial Sequence
  Synthetic Oligonucleotide
aaaauagcaaucccuuuuauuucauug

SEQ ID NO: 9234 - RNA, 27 nt, Artificial Sequence
  Synthetic Oligonucleotide
ggauagcaauaaccugugaaaaugcuc

SEQ ID NO: 9235 - RNA, 27 nt, Artificial Sequence
  Synthetic Oligonucleotide
gcuaauuuguaucaaugauuaugaaca

SEQ ID NO: 9236 - RNA, 27 nt, Artificial Sequence
  Synthetic Oligonucleotide
ugaacaacaugcuaaaucaguacuucc

SEQ ID NO: 9237 - RNA, 27 nt, Artificial Sequence
  Synthetic Oligonucleotide
uuauuucauugcuuuugacuuuucaau

SEQ ID NO: 9238 - RNA, 27 nt, Artificial Sequence
  Synthetic Oligonucleotide
aaauuguaagcucagguucaaaguguu

SEQ ID NO: 9239 - RNA, 27 nt, Artificial Sequence
  Synthetic Oligonucleotide
gacugacaucauugccaauuguugcaa

SEQ ID NO: 9240 - RNA, 27 nt, Artificial Sequence
  Synthetic Oligonucleotide
aaugaucucauuguuuauuaaccugua

SEQ ID NO: 9241 - RNA, 27 nt, Artificial Sequence
  Synthetic Oligonucleotide
ugauuaugaacaacaugcuaaaucagu

SEQ ID NO: 9242 - RNA, 27 nt, Artificial Sequence
  Synthetic Oligonucleotide
aaauggacuuucauccuggaaauauau

SEQ ID NO: 9243 - RNA, 27 nt, Artificial Sequence
  Synthetic Oligonucleotide
aaaguguugguaaugccugauucacaa

SEQ ID NO: 9244 - RNA, 27 nt, Artificial Sequence
  Synthetic Oligonucleotide
uuguaucaaugauuaugaacaacaugc

SEQ ID NO: 9245 - RNA, 27 nt, Artificial Sequence
  Synthetic Oligonucleotide
caaucccuuuuauuucauugcuuuuga

SEQ ID NO: 9246 - RNA, 27 nt, Artificial Sequence
  Synthetic Oligonucleotide
cgguaauuggugauacuucuuugaaug

SEQ ID NO: 9247 - RNA, 27 nt, Artificial Sequence
  Synthetic Oligonucleotide
ucgacaagacauuggugaggaaaaauc

SEQ ID NO: 9248 - RNA, 27 nt, Artificial Sequence
  Synthetic Oligonucleotide
aauagcaaucccuuuuauuucauugcu

SEQ ID NO: 9249 - RNA, 27 nt, Artificial Sequence
  Synthetic Oligonucleotide
uguugguaaugccugauucacaacuuu

SEQ ID NO: 9250 - RNA, 27 nt, Artificial Sequence
  Synthetic Oligonucleotide
auauuaacuguuaaaaagaaaacauug

SEQ ID NO: 9251 - RNA, 27 nt, Artificial Sequence
  Synthetic Oligonucleotide
cucaggaugaaaaauuuugaaaccagu

SEQ ID NO: 9252 - RNA, 27 nt, Artificial Sequence
  Synthetic Oligonucleotide
cugggauagcaauaaccugugaaaaug

SEQ ID NO: 9253 - RNA, 27 nt, Artificial Sequence
  Synthetic Oligonucleotide
aaaaauuuugaaaccaguacuuuauca

SEQ ID NO: 9254 - RNA, 27 nt, Artificial Sequence
  Synthetic Oligonucleotide
uuggugauacuucuuugaauguagauu

SEQ ID NO: 9255 - RNA, 27 nt, Artificial Sequence
  Synthetic Oligonucleotide
uaucaaugauuaugaacaacaugcuaa

SEQ ID NO: 9256 - RNA, 27 nt, Artificial Sequence
  Synthetic Oligonucleotide
guaagcucagguucaaaguguugguaa

SEQ ID NO: 9257 - RNA, 27 nt, Artificial Sequence
  Synthetic Oligonucleotide
cuaauuuguaucaaugauuaugaacaa

SEQ ID NO: 9258 - RNA, 27 nt, Artificial Sequence
  Synthetic Oligonucleotide
uauuucauugcuuuugacuuuucaaug

SEQ ID NO: 9259 - RNA, 27 nt, Artificial Sequence
  Synthetic Oligonucleotide
ucugaauauauccaaauguuuuaggau

SEQ ID NO: 9260 - RNA, 27 nt, Artificial Sequence
  Synthetic Oligonucleotide
augauuaugaacaacaugcuaaaucag

SEQ ID NO: 9261 - RNA, 27 nt, Artificial Sequence
  Synthetic Oligonucleotide
auauauuaacuguuaaaaagaaaacau

SEQ ID NO: 9262 - RNA, 27 nt, Artificial Sequence
  Synthetic Oligonucleotide
guugguaaugccugauucacaacuuug

SEQ ID NO: 9263 - RNA, 27 nt, Artificial Sequence
  Synthetic Oligonucleotide
aggaugaaaaauuuugaaaccaguacu

SEQ ID NO: 9264 - RNA, 27 nt, Artificial Sequence
  Synthetic Oligonucleotide
uuuugaaaccaguacuuuaucauuuuc

SEQ ID NO: 9265 - RNA, 27 nt, Artificial Sequence
  Synthetic Oligonucleotide
uuccaaagucuauauaugacuauuaca

SEQ ID NO: 9266 - RNA, 27 nt, Artificial Sequence
  Synthetic Oligonucleotide
aacucaggaugaaaaauuuugaaacca

SEQ ID NO: 9267 - RNA, 27 nt, Artificial Sequence
  Synthetic Oligonucleotide
uuauuaaccuguauucuguuuacaugu

SEQ ID NO: 9268 - RNA, 27 nt, Artificial Sequence
  Synthetic Oligonucleotide
uuucagcauguauuacuugacaaagag

SEQ ID NO: 9269 - RNA, 27 nt, Artificial Sequence
  Synthetic Oligonucleotide
cacaauauuuucccaucuguauuauuu

SEQ ID NO: 9270 - RNA, 27 nt, Artificial Sequence
  Synthetic Oligonucleotide
gucuguaauuccccacuucaauacaaa

SEQ ID NO: 9271 - RNA, 27 nt, Artificial Sequence
  Synthetic Oligonucleotide
ucaaaguguugguaaugccugauucac

SEQ ID NO: 9272 - RNA, 27 nt, Artificial Sequence
  Synthetic Oligonucleotide
uaaagugcuguauccuuuaguaaaauu

SEQ ID NO: 9273 - RNA, 27 nt, Artificial Sequence
  Synthetic Oligonucleotide
gacuuucauccuggaaauauauuaacu

SEQ ID NO: 9274 - RNA, 27 nt, Artificial Sequence
  Synthetic Oligonucleotide
cuggaugaugugcguaacagauucaaa

SEQ ID NO: 9275 - RNA, 27 nt, Artificial Sequence
  Synthetic Oligonucleotide
ugugaaagucaucgacaagacauuggu

SEQ ID NO: 9276 - RNA, 27 nt, Artificial Sequence
  Synthetic Oligonucleotide
acucaggaugaaaaauuuugaaaccag

SEQ ID NO: 9277 - RNA, 27 nt, Artificial Sequence
  Synthetic Oligonucleotide
ggaaauauauuaacuguuaaaaagaaa

SEQ ID NO: 9278 - RNA, 27 nt, Artificial Sequence
  Synthetic Oligonucleotide
uuuuucagcauguauuacuugacaaag

SEQ ID NO: 9279 - RNA, 27 nt, Artificial Sequence
  Synthetic Oligonucleotide
uuuucagcauguauuacuugacaaaga

SEQ ID NO: 9280 - RNA, 27 nt, Artificial Sequence
  Synthetic Oligonucleotide
ugcacaauauuuucccaucuguauuau

SEQ ID NO: 9281 - RNA, 27 nt, Artificial Sequence
  Synthetic Oligonucleotide
caaacacuaaggugaaaagauaaugau

SEQ ID NO: 9282 - RNA, 27 nt, Artificial Sequence
  Synthetic Oligonucleotide
agaaugugaaagucaucgacaagacau

SEQ ID NO: 9283 - RNA, 27 nt, Artificial Sequence
  Synthetic Oligonucleotide
ugaaaaauuuugaaaccaguacuuuau

SEQ ID NO: 9284 - RNA, 27 nt, Artificial Sequence
  Synthetic Oligonucleotide
auggacuuucauccuggaaauauauua

SEQ ID NO: 9285 - RNA, 27 nt, Artificial Sequence
  Synthetic Oligonucleotide
uaaauuguaagcucagguucaaagugu

SEQ ID NO: 9286 - RNA, 27 nt, Artificial Sequence
  Synthetic Oligonucleotide
cauccuggaaauauauuaacuguuaaa

SEQ ID NO: 9287 - RNA, 27 nt, Artificial Sequence
  Synthetic Oligonucleotide
uauauuaacuguuaaaaagaaaacauu

SEQ ID NO: 9288 - RNA, 27 nt, Artificial Sequence
  Synthetic Oligonucleotide
aaucccuuuuauuucauugcuuuugac

SEQ ID NO: 9289 - RNA, 27 nt, Artificial Sequence
  Synthetic Oligonucleotide
auccaaauguuuuaggauguauguuac

SEQ ID NO: 9290 - RNA, 27 nt, Artificial Sequence
  Synthetic Oligonucleotide
cuguuaaaaagaaaacauugaaaaugu

SEQ ID NO: 9291 - RNA, 27 nt, Artificial Sequence
  Synthetic Oligonucleotide
agacugacaucauugccaauuguugca

SEQ ID NO: 9292 - RNA, 27 nt, Artificial Sequence
  Synthetic Oligonucleotide
uuugaaaccaguacuuuaucauuuucu

SEQ ID NO: 9293 - RNA, 27 nt, Artificial Sequence
  Synthetic Oligonucleotide
cacuauugauguucugccagaaauugu

SEQ ID NO: 9294 - RNA, 27 nt, Artificial Sequence
  Synthetic Oligonucleotide
gaaauauauuaacuguuaaaaagaaaa

SEQ ID NO: 9295 - RNA, 27 nt, Artificial Sequence
  Synthetic Oligonucleotide
aucccuuuuauuucauugcuuuugacu

SEQ ID NO: 9296 - RNA, 27 nt, Artificial Sequence
  Synthetic Oligonucleotide
aucucauuguuuauuaaccuguauucu

SEQ ID NO: 9297 - RNA, 27 nt, Artificial Sequence
  Synthetic Oligonucleotide
uggaugaugugcguaacagauucaaac

SEQ ID NO: 9298 - RNA, 27 nt, Artificial Sequence
  Synthetic Oligonucleotide
gaaauggacuuucauccuggaaauaua

SEQ ID NO: 9299 - RNA, 27 nt, Artificial Sequence
  Synthetic Oligonucleotide
aauuuugaaaccaguacuuuaucauuu

SEQ ID NO: 9300 - RNA, 27 nt, Artificial Sequence
  Synthetic Oligonucleotide
ccacaacucaggaugaaaaauuuugaa

SEQ ID NO: 9301 - RNA, 27 nt, Artificial Sequence
  Synthetic Oligonucleotide
agcauguauuacuugacaaagagacac

SEQ ID NO: 9302 - RNA, 27 nt, Artificial Sequence
  Synthetic Oligonucleotide
uuaaauuguaagcucagguucaaagug

SEQ ID NO: 9303 - RNA, 27 nt, Artificial Sequence
  Synthetic Oligonucleotide
uuguuuauuaaccuguauucuguuuac

SEQ ID NO: 9304 - RNA, 27 nt, Artificial Sequence
  Synthetic Oligonucleotide
ugaaaccaguacuuuaucauuuucucc

SEQ ID NO: 9305 - RNA, 27 nt, Artificial Sequence
  Synthetic Oligonucleotide
cagaaugugaaagucaucgacaagaca

SEQ ID NO: 9306 - RNA, 27 nt, Artificial Sequence
  Synthetic Oligonucleotide
guaucaaugauuaugaacaacaugcua

SEQ ID NO: 9307 - RNA, 27 nt, Artificial Sequence
  Synthetic Oligonucleotide
gauaaugaucucauuguuuauuaaccu

SEQ ID NO: 9308 - RNA, 27 nt, Artificial Sequence
  Synthetic Oligonucleotide
cuguauucuguuuacaugucuuuaaaa

SEQ ID NO: 9309 - RNA, 27 nt, Artificial Sequence
  Synthetic Oligonucleotide
caauauuuucccaucuguauuauuuuu

SEQ ID NO: 9310 - RNA, 27 nt, Artificial Sequence
  Synthetic Oligonucleotide
uuagugucugaauauauccaaauguuu

SEQ ID NO: 9311 - RNA, 27 nt, Artificial Sequence
  Synthetic Oligonucleotide
gcacaauauuuucccaucuguauuauu

SEQ ID NO: 9312 - RNA, 27 nt, Artificial Sequence
  Synthetic Oligonucleotide
gucguucuuuuccaacaaaauagcaau

SEQ ID NO: 9313 - RNA, 27 nt, Artificial Sequence
  Synthetic Oligonucleotide
cugacaucauugccaauuguugcaaag

SEQ ID NO: 9314 - RNA, 27 nt, Artificial Sequence
  Synthetic Oligonucleotide
aaguguugguaaugccugauucacaac

SEQ ID NO: 9315 - RNA, 27 nt, Artificial Sequence
  Synthetic Oligonucleotide
gaagacugacaucauugccaauuguug

SEQ ID NO: 9316 - RNA, 27 nt, Artificial Sequence
  Synthetic Oligonucleotide
gaaaagauaaugaucucauuguuuauu

SEQ ID NO: 9317 - RNA, 27 nt, Artificial Sequence
  Synthetic Oligonucleotide
acaacucaggaugaaaaauuuugaaac

SEQ ID NO: 9318 - RNA, 27 nt, Artificial Sequence
  Synthetic Oligonucleotide
cugauaauauugcagcauuuuccagau

SEQ ID NO: 9319 - RNA, 27 nt, Artificial Sequence
  Synthetic Oligonucleotide
gaaaccaguacuuuaucauuuucuccu

SEQ ID NO: 9320 - RNA, 27 nt, Artificial Sequence
  Synthetic Oligonucleotide
acaauauuuucccaucuguauuauuuu

SEQ ID NO: 9321 - RNA, 27 nt, Artificial Sequence
  Synthetic Oligonucleotide
accaguacuuuaucauuuucuccugag

SEQ ID NO: 9322 - RNA, 27 nt, Artificial Sequence
  Synthetic Oligonucleotide
aucaguacuuccaaagucuauauauga

SEQ ID NO: 9323 - RNA, 27 nt, Artificial Sequence
  Synthetic Oligonucleotide
cacuaaggugaaaagauaaugaucuca

SEQ ID NO: 9324 - RNA, 27 nt, Artificial Sequence
  Synthetic Oligonucleotide
uaagcucagguucaaaguguugguaau

SEQ ID NO: 9325 - RNA, 27 nt, Artificial Sequence
  Synthetic Oligonucleotide
ggcugagaagacugacaucauugccaa

SEQ ID NO: 9326 - RNA, 27 nt, Artificial Sequence
  Synthetic Oligonucleotide
aaggugaaaagauaaugaucucauugu

SEQ ID NO: 9327 - RNA, 27 nt, Artificial Sequence
  Synthetic Oligonucleotide
ccagaaugugaaagucaucgacaagac

SEQ ID NO: 9328 - RNA, 27 nt, Artificial Sequence
  Synthetic Oligonucleotide
cagcauguauuacuugacaaagagaca

SEQ ID NO: 9329 - RNA, 27 nt, Artificial Sequence
  Synthetic Oligonucleotide
uucauugcuuuugacuuuucaaugggu

SEQ ID NO: 9330 - RNA, 27 nt, Artificial Sequence
  Synthetic Oligonucleotide
acuaaggugaaaagauaaugaucucau

SEQ ID NO: 9331 - RNA, 27 nt, Artificial Sequence
  Synthetic Oligonucleotide
ugccugauucacaacuuugagaaggua

SEQ ID NO: 9332 - RNA, 27 nt, Artificial Sequence
  Synthetic Oligonucleotide
agcaaucccuuuuauuucauugcuuuu

SEQ ID NO: 9333 - RNA, 27 nt, Artificial Sequence
  Synthetic Oligonucleotide
uuuauuucauugcuuuugacuuuucaa

SEQ ID NO: 9334 - RNA, 27 nt, Artificial Sequence
  Synthetic Oligonucleotide
cagucuguaauuccccacuucaauaca

SEQ ID NO: 9335 - RNA, 27 nt, Artificial Sequence
  Synthetic Oligonucleotide
ggugauacuucuuugaauguagauuuc

SEQ ID NO: 9336 - RNA, 27 nt, Artificial Sequence
  Synthetic Oligonucleotide
aucaaugauuaugaacaacaugcuaaa

SEQ ID NO: 9337 - RNA, 27 nt, Artificial Sequence
  Synthetic Oligonucleotide
aagugcuguauccuuuaguaaaauugg

SEQ ID NO: 9338 - RNA, 27 nt, Artificial Sequence
  Synthetic Oligonucleotide
gugucguucuuuuccaacaaaauagca

SEQ ID NO: 9339 - RNA, 27 nt, Artificial Sequence
  Synthetic Oligonucleotide
caacaaaauagcaaucccuuuuauuuc

SEQ ID NO: 9340 - RNA, 27 nt, Artificial Sequence
  Synthetic Oligonucleotide
agucuguaauuccccacuucaauacaa

SEQ ID NO: 9341 - RNA, 27 nt, Artificial Sequence
  Synthetic Oligonucleotide
ugaaagucaucgacaagacauugguga

SEQ ID NO: 9342 - RNA, 27 nt, Artificial Sequence
  Synthetic Oligonucleotide
uguuuauuaaccuguauucuguuuaca

SEQ ID NO: 9343 - RNA, 27 nt, Artificial Sequence
  Synthetic Oligonucleotide
guauguuacuucuuagagagaaauaaa

SEQ ID NO: 9344 - RNA, 27 nt, Artificial Sequence
  Synthetic Oligonucleotide
uauccaaauguuuuaggauguauguua

SEQ ID NO: 9345 - RNA, 27 nt, Artificial Sequence
  Synthetic Oligonucleotide
ugguucuuaaauuguaagcucagguuc

SEQ ID NO: 9346 - RNA, 27 nt, Artificial Sequence
  Synthetic Oligonucleotide
uccaacaaaauagcaaucccuuuuauu

SEQ ID NO: 9347 - RNA, 27 nt, Artificial Sequence
  Synthetic Oligonucleotide
augaacaacaugcuaaaucaguacuuc

SEQ ID NO: 9348 - RNA, 27 nt, Artificial Sequence
  Synthetic Oligonucleotide
gcaaacacuaaggugaaaagauaauga

SEQ ID NO: 9349 - RNA, 27 nt, Artificial Sequence
  Synthetic Oligonucleotide
ccggcuaauuuguaucaaugauuauga

SEQ ID NO: 9350 - RNA, 27 nt, Artificial Sequence
  Synthetic Oligonucleotide
aaauagcaaucccuuuuauuucauugc

SEQ ID NO: 9351 - RNA, 27 nt, Artificial Sequence
  Synthetic Oligonucleotide
aauggacuuucauccuggaaauauauu

SEQ ID NO: 9352 - RNA, 27 nt, Artificial Sequence
  Synthetic Oligonucleotide
uggcugauaauauugcagcauuuucca

SEQ ID NO: 9353 - RNA, 27 nt, Artificial Sequence
  Synthetic Oligonucleotide
ccaacaaaauagcaaucccuuuuauuu

SEQ ID NO: 9354 - RNA, 27 nt, Artificial Sequence
  Synthetic Oligonucleotide
aaauguuuuaggauguauguuacuucu

SEQ ID NO: 9355 - RNA, 27 nt, Artificial Sequence
  Synthetic Oligonucleotide
uuuagugucugaauauauccaaauguu

SEQ ID NO: 9356 - RNA, 27 nt, Artificial Sequence
  Synthetic Oligonucleotide
ucccuuuuauuucauugcuuuugacuu

SEQ ID NO: 9357 - RNA, 27 nt, Artificial Sequence
  Synthetic Oligonucleotide
gugucugaauauauccaaauguuuuag

SEQ ID NO: 9358 - RNA, 27 nt, Artificial Sequence
  Synthetic Oligonucleotide
gccagaaugugaaagucaucgacaaga

SEQ ID NO: 9359 - RNA, 27 nt, Artificial Sequence
  Synthetic Oligonucleotide
gaaaaauuuugaaaccaguacuuuauc

SEQ ID NO: 9360 - RNA, 27 nt, Artificial Sequence
  Synthetic Oligonucleotide
uuuuuucagcauguauuacuugacaaa

SEQ ID NO: 9361 - RNA, 27 nt, Artificial Sequence
  Synthetic Oligonucleotide
ugucugaauauauccaaauguuuuagg

SEQ ID NO: 9362 - RNA, 27 nt, Artificial Sequence
  Synthetic Oligonucleotide
ggaugaaaaauuuugaaaccaguacuu

SEQ ID NO: 9363 - RNA, 27 nt, Artificial Sequence
  Synthetic Oligonucleotide
ucaggaugaaaaauuuugaaaccagua

SEQ ID NO: 9364 - RNA, 27 nt, Artificial Sequence
  Synthetic Oligonucleotide
uccaaagucuauauaugacuauuacag

SEQ ID NO: 9365 - RNA, 27 nt, Artificial Sequence
  Synthetic Oligonucleotide
uagugucugaauauauccaaauguuuu

SEQ ID NO: 9366 - RNA, 27 nt, Artificial Sequence
  Synthetic Oligonucleotide
caaugauuaugaacaacaugcuaaauc

SEQ ID NO: 9367 - RNA, 27 nt, Artificial Sequence
  Synthetic Oligonucleotide
uguuaaaaagaaaacauugaaaaugug

SEQ ID NO: 9368 - RNA, 27 nt, Artificial Sequence
  Synthetic Oligonucleotide
ggugaaaagauaaugaucucauuguuu

SEQ ID NO: 9369 - RNA, 27 nt, Artificial Sequence
  Synthetic Oligonucleotide
ugucguucuuuuccaacaaaauagcaa

SEQ ID NO: 9370 - RNA, 27 nt, Artificial Sequence
  Synthetic Oligonucleotide
agugcuguauccuuuaguaaaauugga

SEQ ID NO: 9371 - RNA, 27 nt, Artificial Sequence
  Synthetic Oligonucleotide
aaagugcuguauccuuuaguaaaauug

SEQ ID NO: 9372 - RNA, 27 nt, Artificial Sequence
  Synthetic Oligonucleotide
caaagucuauauaugacuauuacaggu

SEQ ID NO: 9373 - RNA, 27 nt, Artificial Sequence
  Synthetic Oligonucleotide
uucaaaguguugguaaugccugauuca

SEQ ID NO: 9374 - RNA, 27 nt, Artificial Sequence
  Synthetic Oligonucleotide
gcgguaauuggugauacuucuuugaau

SEQ ID NO: 9375 - RNA, 27 nt, Artificial Sequence
  Synthetic Oligonucleotide
uccaaauguuuuaggauguauguuacu

SEQ ID NO: 9376 - RNA, 27 nt, Artificial Sequence
  Synthetic Oligonucleotide
ugauacuucuuugaauguagauuucca

SEQ ID NO: 9377 - RNA, 27 nt, Artificial Sequence
  Synthetic Oligonucleotide
augaucucauuguuuauuaaccuguau

SEQ ID NO: 9378 - RNA, 27 nt, Artificial Sequence
  Synthetic Oligonucleotide
ccaaauguuuuaggauguauguuacuu

SEQ ID NO: 9379 - RNA, 27 nt, Artificial Sequence
  Synthetic Oligonucleotide
cugagaagacugacaucauugccaauu

SEQ ID NO: 9380 - RNA, 27 nt, Artificial Sequence
  Synthetic Oligonucleotide
uaacuguuaaaaagaaaacauugaaaa

SEQ ID NO: 9381 - RNA, 27 nt, Artificial Sequence
  Synthetic Oligonucleotide
acuauugauguucugccagaaauugug

SEQ ID NO: 9382 - RNA, 27 nt, Artificial Sequence
  Synthetic Oligonucleotide
aaaacagugguucuuaaauuguaagcu

SEQ ID NO: 9383 - RNA, 27 nt, Artificial Sequence
  Synthetic Oligonucleotide
acuuucauccuggaaauauauuaacug

SEQ ID NO: 9384 - RNA, 27 nt, Artificial Sequence
  Synthetic Oligonucleotide
aacuuuggcugauaauauugcagcauu

SEQ ID NO: 9385 - RNA, 27 nt, Artificial Sequence
  Synthetic Oligonucleotide
uuaucauuuucuccugaggaaaauuuu

SEQ ID NO: 9386 - RNA, 27 nt, Artificial Sequence
  Synthetic Oligonucleotide
aaaucaguacuuccaaagucuauauau

SEQ ID NO: 9387 - RNA, 27 nt, Artificial Sequence
  Synthetic Oligonucleotide
ccuuuuauuucauugcuuuugacuuuu

SEQ ID NO: 9388 - RNA, 27 nt, Artificial Sequence
  Synthetic Oligonucleotide
agaaauggacuuucauccuggaaauau

SEQ ID NO: 9389 - RNA, 27 nt, Artificial Sequence
  Synthetic Oligonucleotide
uacuuccaaagucuauauaugacuauu

SEQ ID NO: 9390 - RNA, 27 nt, Artificial Sequence
  Synthetic Oligonucleotide
agggugucguucuuuuccaacaaaaua

SEQ ID NO: 9391 - RNA, 27 nt, Artificial Sequence
  Synthetic Oligonucleotide
uaaggugaaaagauaaugaucucauug

SEQ ID NO: 9392 - RNA, 27 nt, Artificial Sequence
  Synthetic Oligonucleotide
uguauuacuugacaaagagacacugug

SEQ ID NO: 9393 - RNA, 27 nt, Artificial Sequence
  Synthetic Oligonucleotide
augaugugcguaacagauucaaacugc

SEQ ID NO: 9394 - RNA, 27 nt, Artificial Sequence
  Synthetic Oligonucleotide
gaugaaaaauuuugaaaccaguacuuu

SEQ ID NO: 9395 - RNA, 27 nt, Artificial Sequence
  Synthetic Oligonucleotide
gcugauaauauugcagcauuuuccaga

SEQ ID NO: 9396 - RNA, 27 nt, Artificial Sequence
  Synthetic Oligonucleotide
ucuggaugaugugcguaacagauucaa

SEQ ID NO: 9397 - RNA, 27 nt, Artificial Sequence
  Synthetic Oligonucleotide
aucgacaagacauuggugaggaaaaau

SEQ ID NO: 9398 - RNA, 27 nt, Artificial Sequence
  Synthetic Oligonucleotide
caaaguguugguaaugccugauucaca

SEQ ID NO: 9399 - RNA, 27 nt, Artificial Sequence
  Synthetic Oligonucleotide
caaauggcugagaagacugacaucauu

SEQ ID NO: 9400 - RNA, 27 nt, Artificial Sequence
  Synthetic Oligonucleotide
augaagaaacuuuggcugauaauauug

SEQ ID NO: 9401 - RNA, 27 nt, Artificial Sequence
  Synthetic Oligonucleotide
ugaaaagauaaugaucucauuguuuau

SEQ ID NO: 9402 - RNA, 27 nt, Artificial Sequence
  Synthetic Oligonucleotide
uuuguaucaaugauuaugaacaacaug

SEQ ID NO: 9403 - RNA, 27 nt, Artificial Sequence
  Synthetic Oligonucleotide
aagacugacaucauugccaauuguugc

SEQ ID NO: 9404 - RNA, 27 nt, Artificial Sequence
  Synthetic Oligonucleotide
guagcaaacacuaaggugaaaagauaa

SEQ ID NO: 9405 - RNA, 27 nt, Artificial Sequence
  Synthetic Oligonucleotide
ggugccagaaugugaaagucaucgaca

SEQ ID NO: 9406 - RNA, 27 nt, Artificial Sequence
  Synthetic Oligonucleotide
agccacuauugauguucugccagaaau

SEQ ID NO: 9407 - RNA, 27 nt, Artificial Sequence
  Synthetic Oligonucleotide
auuuugaaaccaguacuuuaucauuuu

SEQ ID NO: 9408 - RNA, 27 nt, Artificial Sequence
  Synthetic Oligonucleotide
ucuguaauuccccacuucaauacaaag

SEQ ID NO: 9409 - RNA, 27 nt, Artificial Sequence
  Synthetic Oligonucleotide
gauagcaauaaccugugaaaaugcucc

SEQ ID NO: 9410 - RNA, 27 nt, Artificial Sequence
  Synthetic Oligonucleotide
uuaacuguuaaaaagaaaacauugaaa

SEQ ID NO: 9411 - RNA, 27 nt, Artificial Sequence
  Synthetic Oligonucleotide
gccacaacucaggaugaaaaauuuuga

SEQ ID NO: 9412 - RNA, 27 nt, Artificial Sequence
  Synthetic Oligonucleotide
ucagguucaaaguguugguaaugccug

SEQ ID NO: 9413 - RNA, 27 nt, Artificial Sequence
  Synthetic Oligonucleotide
uuaaccuguauucuguuuacaugucuu

SEQ ID NO: 9414 - RNA, 27 nt, Artificial Sequence
  Synthetic Oligonucleotide
caaucacaucuuuagugucugaauaua

SEQ ID NO: 9415 - RNA, 27 nt, Artificial Sequence
  Synthetic Oligonucleotide
uuguaagcucagguucaaaguguuggu

SEQ ID NO: 9416 - RNA, 27 nt, Artificial Sequence
  Synthetic Oligonucleotide
uucuuugaauguagauuuccaaucaca

SEQ ID NO: 9417 - RNA, 27 nt, Artificial Sequence
  Synthetic Oligonucleotide
ccggaauguugcugaaacagaucuguc

SEQ ID NO: 9418 - RNA, 27 nt, Artificial Sequence
  Synthetic Oligonucleotide
auuaacuguuaaaaagaaaacauugaa

SEQ ID NO: 9419 - RNA, 27 nt, Artificial Sequence
  Synthetic Oligonucleotide
aaauauauuaacuguuaaaaagaaaac

SEQ ID NO: 9420 - RNA, 27 nt, Artificial Sequence
  Synthetic Oligonucleotide
caaauguuuuaggauguauguuacuuc

SEQ ID NO: 9421 - RNA, 27 nt, Artificial Sequence
  Synthetic Oligonucleotide
auuuguaucaaugauuaugaacaacau

SEQ ID NO: 9422 - RNA, 27 nt, Artificial Sequence
  Synthetic Oligonucleotide
uuuaaaacagugguucuuaaauuguaa

SEQ ID NO: 9423 - RNA, 27 nt, Artificial Sequence
  Synthetic Oligonucleotide
gaagaaacuuuggcugauaauauugca

SEQ ID NO: 9424 - RNA, 27 nt, Artificial Sequence
  Synthetic Oligonucleotide
ccaagaucugacagugcacaauauuuu

SEQ ID NO: 9425 - RNA, 27 nt, Artificial Sequence
  Synthetic Oligonucleotide
cuaaggugaaaagauaaugaucucauu

SEQ ID NO: 9426 - RNA, 27 nt, Artificial Sequence
  Synthetic Oligonucleotide
uaauauugcagcauuuuccagauggaa

SEQ ID NO: 9427 - RNA, 27 nt, Artificial Sequence
  Synthetic Oligonucleotide
gguagcaaacacuaaggugaaaagaua

SEQ ID NO: 9428 - RNA, 27 nt, Artificial Sequence
  Synthetic Oligonucleotide
uugguaaugccugauucacaacuuuga

SEQ ID NO: 9429 - RNA, 27 nt, Artificial Sequence
  Synthetic Oligonucleotide
aaugugaaagucaucgacaagacauug

SEQ ID NO: 9430 - RNA, 27 nt, Artificial Sequence
  Synthetic Oligonucleotide
uuaaaacagugguucuuaaauuguaag

SEQ ID NO: 9431 - RNA, 27 nt, Artificial Sequence
  Synthetic Oligonucleotide
ccuguauucuguuuacaugucuuuaaa

SEQ ID NO: 9432 - RNA, 27 nt, Artificial Sequence
  Synthetic Oligonucleotide
ugagaagacugacaucauugccaauug

SEQ ID NO: 9433 - RNA, 27 nt, Artificial Sequence
  Synthetic Oligonucleotide
ucuuaaauuguaagcucagguucaaag

SEQ ID NO: 9434 - RNA, 27 nt, Artificial Sequence
  Synthetic Oligonucleotide
uagcaaacacuaaggugaaaagauaau

SEQ ID NO: 9435 - RNA, 27 nt, Artificial Sequence
  Synthetic Oligonucleotide
cucagguucaaaguguugguaaugccu

SEQ ID NO: 9436 - RNA, 27 nt, Artificial Sequence
  Synthetic Oligonucleotide
gacaagacauuggugaggaaaaauccu

SEQ ID NO: 9437 - RNA, 27 nt, Artificial Sequence
  Synthetic Oligonucleotide
agguagcaaacacuaaggugaaaagau

SEQ ID NO: 9438 - RNA, 27 nt, Artificial Sequence
  Synthetic Oligonucleotide
uaaaacagugguucuuaaauuguaagc

SEQ ID NO: 9439 - RNA, 27 nt, Artificial Sequence
  Synthetic Oligonucleotide
guucaaaguguugguaaugccugauuc

SEQ ID NO: 9440 - RNA, 27 nt, Artificial Sequence
  Synthetic Oligonucleotide
uauuaaccuguauucuguuuacauguc

SEQ ID NO: 9441 - RNA, 27 nt, Artificial Sequence
  Synthetic Oligonucleotide
guguugguaaugccugauucacaacuu

SEQ ID NO: 9442 - RNA, 27 nt, Artificial Sequence
  Synthetic Oligonucleotide
ucaguacuuccaaagucuauauaugac

SEQ ID NO: 9443 - RNA, 27 nt, Artificial Sequence
  Synthetic Oligonucleotide
caguacuuccaaagucuauauaugacu

SEQ ID NO: 9444 - RNA, 27 nt, Artificial Sequence
  Synthetic Oligonucleotide
ucaaugauuaugaacaacaugcuaaau

SEQ ID NO: 9445 - RNA, 27 nt, Artificial Sequence
  Synthetic Oligonucleotide
uguucaagauguccucgagauacuaaa

SEQ ID NO: 9446 - RNA, 27 nt, Artificial Sequence
  Synthetic Oligonucleotide
cuuuaaaacagugguucuuaaauugua

SEQ ID NO: 9447 - RNA, 27 nt, Artificial Sequence
  Synthetic Oligonucleotide
gaucucauuguuuauuaaccuguauuc

SEQ ID NO: 9448 - RNA, 27 nt, Artificial Sequence
  Synthetic Oligonucleotide
aguguugguaaugccugauucacaacu

SEQ ID NO: 9449 - RNA, 27 nt, Artificial Sequence
  Synthetic Oligonucleotide
acaacaugcuaaaucaguacuuccaaa

SEQ ID NO: 9450 - RNA, 27 nt, Artificial Sequence
  Synthetic Oligonucleotide
uucuuaaauuguaagcucagguucaaa

SEQ ID NO: 9451 - RNA, 27 nt, Artificial Sequence
  Synthetic Oligonucleotide
uucguuggcugcaacuguauaucuaca

SEQ ID NO: 9452 - RNA, 27 nt, Artificial Sequence
  Synthetic Oligonucleotide
uaaaucaguacuuccaaagucuauaua

SEQ ID NO: 9453 - RNA, 27 nt, Artificial Sequence
  Synthetic Oligonucleotide
acaagacauuggugaggaaaaauccuu

SEQ ID NO: 9454 - RNA, 27 nt, Artificial Sequence
  Synthetic Oligonucleotide
gcauguauuacuugacaaagagacacu

SEQ ID NO: 9455 - RNA, 27 nt, Artificial Sequence
  Synthetic Oligonucleotide
gugauacuucuuugaauguagauuucc

SEQ ID NO: 9456 - RNA, 27 nt, Artificial Sequence
  Synthetic Oligonucleotide
caagaucugacagugcacaauauuuuc

SEQ ID NO: 9457 - RNA, 27 nt, Artificial Sequence
  Synthetic Oligonucleotide
acaucuuuagugucugaauauauccaa

SEQ ID NO: 9458 - RNA, 27 nt, Artificial Sequence
  Synthetic Oligonucleotide
agcaaacacuaaggugaaaagauaaug

SEQ ID NO: 9459 - RNA, 27 nt, Artificial Sequence
  Synthetic Oligonucleotide
auagcaauaaccugugaaaaugcuccc

SEQ ID NO: 9460 - RNA, 27 nt, Artificial Sequence
  Synthetic Oligonucleotide
aauauauuaacuguuaaaaagaaaaca

SEQ ID NO: 9461 - RNA, 27 nt, Artificial Sequence
  Synthetic Oligonucleotide
ugaugugcguaacagauucaaacugcc

SEQ ID NO: 9462 - RNA, 27 nt, Artificial Sequence
  Synthetic Oligonucleotide
aaucaguacuuccaaagucuauauaug

SEQ ID NO: 9463 - RNA, 27 nt, Artificial Sequence
  Synthetic Oligonucleotide
gguaauuggugauacuucuuugaaugu

SEQ ID NO: 9464 - RNA, 27 nt, Artificial Sequence
  Synthetic Oligonucleotide
uuccaacaaaauagcaaucccuuuuau

SEQ ID NO: 9465 - RNA, 27 nt, Artificial Sequence
  Synthetic Oligonucleotide
uguaagcucagguucaaaguguuggua

SEQ ID NO: 9466 - RNA, 27 nt, Artificial Sequence
  Synthetic Oligonucleotide
aucugacagugcacaauauuuucccau

SEQ ID NO: 9467 - RNA, 27 nt, Artificial Sequence
  Synthetic Oligonucleotide
uugcagcauuuuccagauggaagcugu

SEQ ID NO: 9468 - RNA, 27 nt, Artificial Sequence
  Synthetic Oligonucleotide
gugguucuuaaauuguaagcucagguu

SEQ ID NO: 9469 - RNA, 27 nt, Artificial Sequence
  Synthetic Oligonucleotide
ugaugaagaaacuuuggcugauaauau

SEQ ID NO: 9470 - RNA, 27 nt, Artificial Sequence
  Synthetic Oligonucleotide
aaacacuaaggugaaaagauaaugauc

SEQ ID NO: 9471 - RNA, 27 nt, Artificial Sequence
  Synthetic Oligonucleotide
auuguuuauuaaccuguauucuguuua

SEQ ID NO: 9472 - RNA, 27 nt, Artificial Sequence
  Synthetic Oligonucleotide
cgccacaacucaggaugaaaaauuuug

SEQ ID NO: 9473 - RNA, 27 nt, Artificial Sequence
  Synthetic Oligonucleotide
agaaacuuuggcugauaauauugcagc

SEQ ID NO: 9474 - RNA, 27 nt, Artificial Sequence
  Synthetic Oligonucleotide
gugcacaauauuuucccaucuguauua

SEQ ID NO: 9475 - RNA, 27 nt, Artificial Sequence
  Synthetic Oligonucleotide
gugaaagucaucgacaagacauuggug

SEQ ID NO: 9476 - RNA, 27 nt, Artificial Sequence
  Synthetic Oligonucleotide
gauuaugaacaacaugcuaaaucagua

SEQ ID NO: 9477 - RNA, 27 nt, Artificial Sequence
  Synthetic Oligonucleotide
accuguauucuguuuacaugucuuuaa

SEQ ID NO: 9478 - RNA, 27 nt, Artificial Sequence
  Synthetic Oligonucleotide
ugauaauauugcagcauuuuccagaug

SEQ ID NO: 9479 - RNA, 27 nt, Artificial Sequence
  Synthetic Oligonucleotide
auauuuucccaucuguauuauuuuuuu

SEQ ID NO: 9480 - RNA, 27 nt, Artificial Sequence
  Synthetic Oligonucleotide
uguauguuacuucuuagagagaaauaa

SEQ ID NO: 9481 - RNA, 27 nt, Artificial Sequence
  Synthetic Oligonucleotide
ucaucgacaagacauuggugaggaaaa

SEQ ID NO: 9482 - RNA, 27 nt, Artificial Sequence
  Synthetic Oligonucleotide
agcucagguucaaaguguugguaaugc

SEQ ID NO: 9483 - RNA, 27 nt, Artificial Sequence
  Synthetic Oligonucleotide
auguauuacuugacaaagagacacugu

SEQ ID NO: 9484 - RNA, 27 nt, Artificial Sequence
  Synthetic Oligonucleotide
cauguauuacuugacaaagagacacug

SEQ ID NO: 9485 - RNA, 27 nt, Artificial Sequence
  Synthetic Oligonucleotide
ggugucguucuuuuccaacaaaauagc

SEQ ID NO: 9486 - RNA, 27 nt, Artificial Sequence
  Synthetic Oligonucleotide
ccaaagucuauauaugacuauuacagg

SEQ ID NO: 9487 - RNA, 27 nt, Artificial Sequence
  Synthetic Oligonucleotide
gagguagcaaacacuaaggugaaaaga

SEQ ID NO: 9488 - RNA, 27 nt, Artificial Sequence
  Synthetic Oligonucleotide
auaucaaauggcugagaagacugacau

SEQ ID NO: 9489 - RNA, 27 nt, Artificial Sequence
  Synthetic Oligonucleotide
aaaccaguacuuuaucauuuucuccug

SEQ ID NO: 9490 - RNA, 27 nt, Artificial Sequence
  Synthetic Oligonucleotide
gguaaugccugauucacaacuuugaga

SEQ ID NO: 9491 - RNA, 27 nt, Artificial Sequence
  Synthetic Oligonucleotide
ccacuauugauguucugccagaaauug

SEQ ID NO: 9492 - RNA, 27 nt, Artificial Sequence
  Synthetic Oligonucleotide
guuuauuaaccuguauucuguuuacau

SEQ ID NO: 9493 - RNA, 27 nt, Artificial Sequence
  Synthetic Oligonucleotide
cuauugauguucugccagaaauugugg

SEQ ID NO: 9494 - RNA, 27 nt, Artificial Sequence
  Synthetic Oligonucleotide
caggaugaaaaauuuugaaaccaguac

SEQ ID NO: 9495 - RNA, 27 nt, Artificial Sequence
  Synthetic Oligonucleotide
uaucauuuucuccugaggaaaauuuug

SEQ ID NO: 9496 - RNA, 27 nt, Artificial Sequence
  Synthetic Oligonucleotide
ugguaaugccugauucacaacuuugag

SEQ ID NO: 9497 - RNA, 27 nt, Artificial Sequence
  Synthetic Oligonucleotide
aaccuguauucuguuuacaugucuuua

SEQ ID NO: 9498 - RNA, 27 nt, Artificial Sequence
  Synthetic Oligonucleotide
aagucaucgacaagacauuggugagga

SEQ ID NO: 9499 - RNA, 27 nt, Artificial Sequence
  Synthetic Oligonucleotide
ugaagaaacuuuggcugauaauauugc

SEQ ID NO: 9500 - RNA, 27 nt, Artificial Sequence
  Synthetic Oligonucleotide
acagugguucuuaaauuguaagcucag

SEQ ID NO: 9501 - RNA, 27 nt, Artificial Sequence
  Synthetic Oligonucleotide
aauauauccaaauguuuuaggauguau

SEQ ID NO: 9502 - RNA, 27 nt, Artificial Sequence
  Synthetic Oligonucleotide
caagacauuggugaggaaaaauccuuu

SEQ ID NO: 9503 - RNA, 27 nt, Artificial Sequence
  Synthetic Oligonucleotide
ucugacagugcacaauauuuucccauc

SEQ ID NO: 9504 - RNA, 27 nt, Artificial Sequence
  Synthetic Oligonucleotide
gugccagaaugugaaagucaucgacaa

SEQ ID NO: 9505 - RNA, 27 nt, Artificial Sequence
  Synthetic Oligonucleotide
ugaauguagauuuccaaucacaucuuu

SEQ ID NO: 9506 - RNA, 27 nt, Artificial Sequence
  Synthetic Oligonucleotide
acuguuaaaaagaaaacauugaaaaug

SEQ ID NO: 9507 - RNA, 27 nt, Artificial Sequence
  Synthetic Oligonucleotide
uaugaacaacaugcuaaaucaguacuu

SEQ ID NO: 9508 - RNA, 27 nt, Artificial Sequence
  Synthetic Oligonucleotide
uguaucaaugauuaugaacaacaugcu

SEQ ID NO: 9509 - RNA, 27 nt, Artificial Sequence
  Synthetic Oligonucleotide
guauucuguuuacaugucuuuaaaaca

SEQ ID NO: 9510 - RNA, 27 nt, Artificial Sequence
  Synthetic Oligonucleotide
caacucaggaugaaaaauuuugaaacc

SEQ ID NO: 9511 - RNA, 27 nt, Artificial Sequence
  Synthetic Oligonucleotide
auauccaaauguuuuaggauguauguu

SEQ ID NO: 9512 - RNA, 27 nt, Artificial Sequence
  Synthetic Oligonucleotide
ggcgguaauuggugauacuucuuugaa

SEQ ID NO: 9513 - RNA, 27 nt, Artificial Sequence
  Synthetic Oligonucleotide
gaugaagaaacuuuggcugauaauauu

SEQ ID NO: 9514 - RNA, 27 nt, Artificial Sequence
  Synthetic Oligonucleotide
uuucauugcuuuugacuuuucaauggg

SEQ ID NO: 9515 - RNA, 27 nt, Artificial Sequence
  Synthetic Oligonucleotide
agugucugaauauauccaaauguuuua

SEQ ID NO: 9516 - RNA, 27 nt, Artificial Sequence
  Synthetic Oligonucleotide
cauuguuuauuaaccuguauucuguuu

SEQ ID NO: 9517 - RNA, 27 nt, Artificial Sequence
  Synthetic Oligonucleotide
auauauccaaauguuuuaggauguaug

SEQ ID NO: 9518 - RNA, 27 nt, Artificial Sequence
  Synthetic Oligonucleotide
gacagugcacaauauuuucccaucugu

SEQ ID NO: 9519 - RNA, 27 nt, Artificial Sequence
  Synthetic Oligonucleotide
uaaccuguauucuguuuacaugucuuu

SEQ ID NO: 9520 - RNA, 27 nt, Artificial Sequence
  Synthetic Oligonucleotide
uaaugccugauucacaacuuugagaag

SEQ ID NO: 9521 - RNA, 27 nt, Artificial Sequence
  Synthetic Oligonucleotide
uauugauguucugccagaaauugugga

SEQ ID NO: 9522 - RNA, 27 nt, Artificial Sequence
  Synthetic Oligonucleotide
uugaauguagauuuccaaucacaucuu

SEQ ID NO: 9523 - RNA, 27 nt, Artificial Sequence
  Synthetic Oligonucleotide
cccuuuuauuucauugcuuuugacuuu

SEQ ID NO: 9524 - RNA, 27 nt, Artificial Sequence
  Synthetic Oligonucleotide
ugccagaaugugaaagucaucgacaag

SEQ ID NO: 9525 - RNA, 27 nt, Artificial Sequence
  Synthetic Oligonucleotide
gaaugugaaagucaucgacaagacauu

SEQ ID NO: 9526 - RNA, 27 nt, Artificial Sequence
  Synthetic Oligonucleotide
ggaugaugugcguaacagauucaaacu

SEQ ID NO: 9527 - RNA, 27 nt, Artificial Sequence
  Synthetic Oligonucleotide
aagcucagguucaaaguguugguaaug

SEQ ID NO: 9528 - RNA, 27 nt, Artificial Sequence
  Synthetic Oligonucleotide
uauucuguuuacaugucuuuaaaacag

SEQ ID NO: 9529 - RNA, 27 nt, Artificial Sequence
  Synthetic Oligonucleotide
cgacaagacauuggugaggaaaaaucc

SEQ ID NO: 9530 - RNA, 27 nt, Artificial Sequence
  Synthetic Oligonucleotide
uaguaaaauuggagguagcaaacacua

SEQ ID NO: 9531 - RNA, 27 nt, Artificial Sequence
  Synthetic Oligonucleotide
aguacuuccaaagucuauauaugacua

SEQ ID NO: 9532 - RNA, 27 nt, Artificial Sequence
  Synthetic Oligonucleotide
gaauguagauuuccaaucacaucuuua

SEQ ID NO: 9533 - RNA, 27 nt, Artificial Sequence
  Synthetic Oligonucleotide
uccaagaucugacagugcacaauauuu

SEQ ID NO: 9534 - RNA, 27 nt, Artificial Sequence
  Synthetic Oligonucleotide
auacuucuuugaauguagauuuccaau

SEQ ID NO: 9535 - RNA, 27 nt, Artificial Sequence
  Synthetic Oligonucleotide
ggcugauaauauugcagcauuuuccag

SEQ ID NO: 9536 - RNA, 27 nt, Artificial Sequence
  Synthetic Oligonucleotide
augcuaaaucaguacuuccaaagucua

SEQ ID NO: 9537 - RNA, 27 nt, Artificial Sequence
  Synthetic Oligonucleotide
uagagagaaauaaagcauuuuugggaa

SEQ ID NO: 9538 - RNA, 27 nt, Artificial Sequence
  Synthetic Oligonucleotide
gaauauauccaaauguuuuaggaugua

SEQ ID NO: 9539 - RNA, 27 nt, Artificial Sequence
  Synthetic Oligonucleotide
uuuuauuucauugcuuuugacuuuuca

SEQ ID NO: 9540 - RNA, 27 nt, Artificial Sequence
  Synthetic Oligonucleotide
acagugcacaauauuuucccaucugua

SEQ ID NO: 9541 - RNA, 27 nt, Artificial Sequence
  Synthetic Oligonucleotide
aucacaucuuuagugucugaauauauc

SEQ ID NO: 9542 - RNA, 27 nt, Artificial Sequence
  Synthetic Oligonucleotide
auguauguuacuucuuagagagaaaua

SEQ ID NO: 9543 - RNA, 27 nt, Artificial Sequence
  Synthetic Oligonucleotide
cuaggaaccuuuuagaaagaaauggac

SEQ ID NO: 9544 - RNA, 27 nt, Artificial Sequence
  Synthetic Oligonucleotide
guguucaagauguccucgagauacuaa

SEQ ID NO: 9545 - RNA, 27 nt, Artificial Sequence
  Synthetic Oligonucleotide
cccggcuaauuuguaucaaugauuaug

SEQ ID NO: 9546 - RNA, 27 nt, Artificial Sequence
  Synthetic Oligonucleotide
aaagggugucguucuuuuccaacaaaa

SEQ ID NO: 9547 - RNA, 27 nt, Artificial Sequence
  Synthetic Oligonucleotide
aaccuuuuagaaagaaauggacuuuca

SEQ ID NO: 9548 - RNA, 27 nt, Artificial Sequence
  Synthetic Oligonucleotide
ucauugcuuuugacuuuucaaugggug

SEQ ID NO: 9549 - RNA, 27 nt, Artificial Sequence
  Synthetic Oligonucleotide
aucaaauggcugagaagacugacauca

SEQ ID NO: 9550 - RNA, 27 nt, Artificial Sequence
  Synthetic Oligonucleotide
ucguucuuuuccaacaaaauagcaauc

SEQ ID NO: 9551 - RNA, 27 nt, Artificial Sequence
  Synthetic Oligonucleotide
gggugucguucuuuuccaacaaaauag

SEQ ID NO: 9552 - RNA, 27 nt, Artificial Sequence
  Synthetic Oligonucleotide
uuuauuaaccuguauucuguuuacaug

SEQ ID NO: 9553 - RNA, 27 nt, Artificial Sequence
  Synthetic Oligonucleotide
cuuaaauuguaagcucagguucaaagu

SEQ ID NO: 9554 - RNA, 27 nt, Artificial Sequence
  Synthetic Oligonucleotide
uggcugagaagacugacaucauugcca

SEQ ID NO: 9555 - RNA, 27 nt, Artificial Sequence
  Synthetic Oligonucleotide
uccggaauguugcugaaacagaucugu

SEQ ID NO: 9556 - RNA, 27 nt, Artificial Sequence
  Synthetic Oligonucleotide
ugaauauauccaaauguuuuaggaugu

SEQ ID NO: 9557 - RNA, 27 nt, Artificial Sequence
  Synthetic Oligonucleotide
cacagucuguaauuccccacuucaaua

SEQ ID NO: 9558 - RNA, 27 nt, Artificial Sequence
  Synthetic Oligonucleotide
uuggcugcaacuguauaucuacaagga

SEQ ID NO: 9559 - RNA, 27 nt, Artificial Sequence
  Synthetic Oligonucleotide
uauuaacuguuaaaaagaaaacauuga

SEQ ID NO: 9560 - RNA, 27 nt, Artificial Sequence
  Synthetic Oligonucleotide
augaugaagaaacuuuggcugauaaua

SEQ ID NO: 9561 - RNA, 27 nt, Artificial Sequence
  Synthetic Oligonucleotide
aacaacaugcuaaaucaguacuuccaa

SEQ ID NO: 9562 - RNA, 27 nt, Artificial Sequence
  Synthetic Oligonucleotide
auuggugauacuucuuugaauguagau

SEQ ID NO: 9563 - RNA, 27 nt, Artificial Sequence
  Synthetic Oligonucleotide
ugauucacaacuuugagaagguagcac

SEQ ID NO: 9564 - RNA, 27 nt, Artificial Sequence
  Synthetic Oligonucleotide
auuucauugcuuuugacuuuucaaugg

SEQ ID NO: 9565 - RNA, 27 nt, Artificial Sequence
  Synthetic Oligonucleotide
cauuuuccagauggaagcuguauccaa

SEQ ID NO: 9566 - RNA, 27 nt, Artificial Sequence
  Synthetic Oligonucleotide
uguauucuguuuacaugucuuuaaaac

SEQ ID NO: 9567 - RNA, 27 nt, Artificial Sequence
  Synthetic Oligonucleotide
uacuugacaaagagacacugugcagag

SEQ ID NO: 9568 - RNA, 27 nt, Artificial Sequence
  Synthetic Oligonucleotide
agguucaaaguguugguaaugccugau

SEQ ID NO: 9569 - RNA, 27 nt, Artificial Sequence
  Synthetic Oligonucleotide
aacuguuaaaaagaaaacauugaaaau

SEQ ID NO: 9570 - RNA, 27 nt, Artificial Sequence
  Synthetic Oligonucleotide
caauacaaagggugucguucuuuucca

SEQ ID NO: 9571 - RNA, 27 nt, Artificial Sequence
  Synthetic Oligonucleotide
uacuuuaucauuuucuccugaggaaaa

SEQ ID NO: 9572 - RNA, 27 nt, Artificial Sequence
  Synthetic Oligonucleotide
ucuuuaaaacagugguucuuaaauugu

SEQ ID NO: 9573 - RNA, 27 nt, Artificial Sequence
  Synthetic Oligonucleotide
uccaaucacaucuuuagugucugaaua

SEQ ID NO: 9574 - RNA, 27 nt, Artificial Sequence
  Synthetic Oligonucleotide
cuuccaaagucuauauaugacuauuac

SEQ ID NO: 9575 - RNA, 27 nt, Artificial Sequence
  Synthetic Oligonucleotide
uuuaucauuuucuccugaggaaaauuu

SEQ ID NO: 9576 - RNA, 27 nt, Artificial Sequence
  Synthetic Oligonucleotide
uauguuacuucuuagagagaaauaaag

SEQ ID NO: 9577 - RNA, 27 nt, Artificial Sequence
  Synthetic Oligonucleotide
caguacuuuaucauuuucuccugagga

SEQ ID NO: 9578 - RNA, 27 nt, Artificial Sequence
  Synthetic Oligonucleotide
gaucugacagugcacaauauuuuccca

SEQ ID NO: 9579 - RNA, 27 nt, Artificial Sequence
  Synthetic Oligonucleotide
ucaagauguccucgagauacuaaagga

SEQ ID NO: 9580 - RNA, 27 nt, Artificial Sequence
  Synthetic Oligonucleotide
uuacuugacaaagagacacugugcaga

SEQ ID NO: 9581 - RNA, 27 nt, Artificial Sequence
  Synthetic Oligonucleotide
aaugccugauucacaacuuugagaagg

SEQ ID NO: 9582 - RNA, 27 nt, Artificial Sequence
  Synthetic Oligonucleotide
auuaugaacaacaugcuaaaucaguac

SEQ ID NO: 9583 - RNA, 27 nt, Artificial Sequence
  Synthetic Oligonucleotide
aauuguaagcucagguucaaaguguug

SEQ ID NO: 9584 - RNA, 27 nt, Artificial Sequence
  Synthetic Oligonucleotide
aagaaauggacuuucauccuggaaaua

SEQ ID NO: 9585 - RNA, 27 nt, Artificial Sequence
  Synthetic Oligonucleotide
cuaaagugcuguauccuuuaguaaaau

SEQ ID NO: 9586 - RNA, 27 nt, Artificial Sequence
  Synthetic Oligonucleotide
ugagugggugccagaaugugaaaguca

SEQ ID NO: 9587 - RNA, 27 nt, Artificial Sequence
  Synthetic Oligonucleotide
aggauguauguuacuucuuagagagaa

SEQ ID NO: 9588 - RNA, 27 nt, Artificial Sequence
  Synthetic Oligonucleotide
augugaaagucaucgacaagacauugg

SEQ ID NO: 9589 - RNA, 27 nt, Artificial Sequence
  Synthetic Oligonucleotide
gaagauaucaaauggcugagaagacug

SEQ ID NO: 9590 - RNA, 27 nt, Artificial Sequence
  Synthetic Oligonucleotide
auucuguuuacaugucuuuaaaacagu

SEQ ID NO: 9591 - RNA, 27 nt, Artificial Sequence
  Synthetic Oligonucleotide
aacacuaaggugaaaagauaaugaucu

SEQ ID NO: 9592 - RNA, 27 nt, Artificial Sequence
  Synthetic Oligonucleotide
aagucuauauaugacuauuacaggucu

SEQ ID NO: 9593 - RNA, 27 nt, Artificial Sequence
  Synthetic Oligonucleotide
guacuuuaucauuuucuccugaggaaa

SEQ ID NO: 9594 - RNA, 27 nt, Artificial Sequence
  Synthetic Oligonucleotide
ugcagcauuuuccagauggaagcugua

SEQ ID NO: 9595 - RNA, 27 nt, Artificial Sequence
  Synthetic Oligonucleotide
caucuuuagugucugaauauauccaaa

SEQ ID NO: 9596 - RNA, 27 nt, Artificial Sequence
  Synthetic Oligonucleotide
gggugccagaaugugaaagucaucgac

SEQ ID NO: 9597 - RNA, 27 nt, Artificial Sequence
  Synthetic Oligonucleotide
gauguauguuacuucuuagagagaaau

SEQ ID NO: 9598 - RNA, 27 nt, Artificial Sequence
  Synthetic Oligonucleotide
aaauggcugagaagacugacaucauug

SEQ ID NO: 9599 - RNA, 27 nt, Artificial Sequence
  Synthetic Oligonucleotide
cacaucuuuagugucugaauauaucca

SEQ ID NO: 9600 - RNA, 27 nt, Artificial Sequence
  Synthetic Oligonucleotide
aagaaacuuuggcugauaauauugcag

SEQ ID NO: 9601 - RNA, 27 nt, Artificial Sequence
  Synthetic Oligonucleotide
caagauguccucgagauacuaaaggaa

SEQ ID NO: 9602 - RNA, 27 nt, Artificial Sequence
  Synthetic Oligonucleotide
gucaucgacaagacauuggugaggaaa

SEQ ID NO: 9603 - RNA, 27 nt, Artificial Sequence
  Synthetic Oligonucleotide
aagaucugacagugcacaauauuuucc

SEQ ID NO: 9604 - RNA, 27 nt, Artificial Sequence
  Synthetic Oligonucleotide
augccugauucacaacuuugagaaggu

SEQ ID NO: 9605 - RNA, 27 nt, Artificial Sequence
  Synthetic Oligonucleotide
ugcugcauauguggcuaaagcaauaga

SEQ ID NO: 9606 - RNA, 27 nt, Artificial Sequence
  Synthetic Oligonucleotide
uaggaaccuuuuagaaagaaauggacu

SEQ ID NO: 9607 - RNA, 27 nt, Artificial Sequence
  Synthetic Oligonucleotide
gguucaaaguguugguaaugccugauu

SEQ ID NO: 9608 - RNA, 27 nt, Artificial Sequence
  Synthetic Oligonucleotide
gugcuguauccuuuaguaaaauuggag

SEQ ID NO: 9609 - RNA, 27 nt, Artificial Sequence
  Synthetic Oligonucleotide
ccgccacaacucaggaugaaaaauuuu

SEQ ID NO: 9610 - RNA, 27 nt, Artificial Sequence
  Synthetic Oligonucleotide
ucacaucuuuagugucugaauauaucc

SEQ ID NO: 9611 - RNA, 27 nt, Artificial Sequence
  Synthetic Oligonucleotide
cagguucaaaguguugguaaugccuga

SEQ ID NO: 9612 - RNA, 27 nt, Artificial Sequence
  Synthetic Oligonucleotide
ucauuuucuccugaggaaaauuuugga

SEQ ID NO: 9613 - RNA, 27 nt, Artificial Sequence
  Synthetic Oligonucleotide
ucguuggcugcaacuguauaucuacaa

SEQ ID NO: 9614 - RNA, 27 nt, Artificial Sequence
  Synthetic Oligonucleotide
cacuucguuggcugcaacuguauaucu

SEQ ID NO: 9615 - RNA, 27 nt, Artificial Sequence
  Synthetic Oligonucleotide
cuuuuauuucauugcuuuugacuuuuc

SEQ ID NO: 9616 - RNA, 27 nt, Artificial Sequence
  Synthetic Oligonucleotide
aauauuuucccaucuguauuauuuuuu

SEQ ID NO: 9617 - RNA, 27 nt, Artificial Sequence
  Synthetic Oligonucleotide
ugacaucauugccaauuguugcaaagg

SEQ ID NO: 9618 - RNA, 27 nt, Artificial Sequence
  Synthetic Oligonucleotide
gagaaauaaagcauuuuugggaagaau

SEQ ID NO: 9619 - RNA, 27 nt, Artificial Sequence
  Synthetic Oligonucleotide
acagucuguaauuccccacuucaauac

SEQ ID NO: 9620 - RNA, 27 nt, Artificial Sequence
  Synthetic Oligonucleotide
gcugagaagacugacaucauugccaau

SEQ ID NO: 9621 - RNA, 27 nt, Artificial Sequence
  Synthetic Oligonucleotide
uucuuuuccaacaaaauagcaaucccu

SEQ ID NO: 9622 - RNA, 27 nt, Artificial Sequence
  Synthetic Oligonucleotide
gccacuauugauguucugccagaaauu

SEQ ID NO: 9623 - RNA, 27 nt, Artificial Sequence
  Synthetic Oligonucleotide
gaacaacaugcuaaaucaguacuucca

SEQ ID NO: 9624 - RNA, 27 nt, Artificial Sequence
  Synthetic Oligonucleotide
uccuuuaguaaaauuggagguagcaaa

SEQ ID NO: 9625 - RNA, 27 nt, Artificial Sequence
  Synthetic Oligonucleotide
ugcuuuugacuuuucaauggguguccu

SEQ ID NO: 9626 - RNA, 27 nt, Artificial Sequence
  Synthetic Oligonucleotide
accuuuuagaaagaaauggacuuucau

SEQ ID NO: 9627 - RNA, 27 nt, Artificial Sequence
  Synthetic Oligonucleotide
ccaaucacaucuuuagugucugaauau

SEQ ID NO: 9628 - RNA, 27 nt, Artificial Sequence
  Synthetic Oligonucleotide
aauauugcagcauuuuccagauggaag

SEQ ID NO: 9629 - RNA, 27 nt, Artificial Sequence
  Synthetic Oligonucleotide
guuggcugcaacuguauaucuacaagg

SEQ ID NO: 9630 - RNA, 27 nt, Artificial Sequence
  Synthetic Oligonucleotide
uauuacuugacaaagagacacugugca

SEQ ID NO: 9631 - RNA, 27 nt, Artificial Sequence
  Synthetic Oligonucleotide
ccaucuaucagcugggaagauaucaaa

SEQ ID NO: 9632 - RNA, 27 nt, Artificial Sequence
  Synthetic Oligonucleotide
cuuuagugucugaauauauccaaaugu

SEQ ID NO: 9633 - RNA, 27 nt, Artificial Sequence
  Synthetic Oligonucleotide
aaucacaucuuuagugucugaauauau

SEQ ID NO: 9634 - RNA, 27 nt, Artificial Sequence
  Synthetic Oligonucleotide
gcaaucccuuuuauuucauugcuuuug

SEQ ID NO: 9635 - RNA, 27 nt, Artificial Sequence
  Synthetic Oligonucleotide
aucuuuagugucugaauauauccaaau

SEQ ID NO: 9636 - RNA, 27 nt, Artificial Sequence
  Synthetic Oligonucleotide
auuaaccuguauucuguuuacaugucu

SEQ ID NO: 9637 - RNA, 27 nt, Artificial Sequence
  Synthetic Oligonucleotide
gacaucauugccaauuguugcaaaggg

SEQ ID NO: 9638 - RNA, 27 nt, Artificial Sequence
  Synthetic Oligonucleotide
caaagggugucguucuuuuccaacaaa

SEQ ID NO: 9639 - RNA, 27 nt, Artificial Sequence
  Synthetic Oligonucleotide
uguccucgagauacuaaaggaagaauu

SEQ ID NO: 9640 - RNA, 27 nt, Artificial Sequence
  Synthetic Oligonucleotide
uguuacuucuuagagagaaauaaagca

SEQ ID NO: 9641 - RNA, 27 nt, Artificial Sequence
  Synthetic Oligonucleotide
auacaaagggugucguucuuuuccaac

SEQ ID NO: 9642 - RNA, 27 nt, Artificial Sequence
  Synthetic Oligonucleotide
uuaggauguauguuacuucuuagagag

SEQ ID NO: 9643 - RNA, 27 nt, Artificial Sequence
  Synthetic Oligonucleotide
uuggcugauaauauugcagcauuuucc

SEQ ID NO: 9644 - RNA, 27 nt, Artificial Sequence
  Synthetic Oligonucleotide
uuccaagaucugacagugcacaauauu

SEQ ID NO: 9645 - RNA, 27 nt, Artificial Sequence
  Synthetic Oligonucleotide
ucaaauggcugagaagacugacaucau

SEQ ID NO: 9646 - RNA, 27 nt, Artificial Sequence
  Synthetic Oligonucleotide
acuuccaaagucuauauaugacuauua

SEQ ID NO: 9647 - RNA, 27 nt, Artificial Sequence
  Synthetic Oligonucleotide
uuagagagaaauaaagcauuuuuggga

SEQ ID NO: 9648 - RNA, 27 nt, Artificial Sequence
  Synthetic Oligonucleotide
guuacuucuuagagagaaauaaagcau

SEQ ID NO: 9649 - RNA, 27 nt, Artificial Sequence
  Synthetic Oligonucleotide
ugggugccagaaugugaaagucaucga

SEQ ID NO: 9650 - RNA, 27 nt, Artificial Sequence
  Synthetic Oligonucleotide
gcucagguucaaaguguugguaaugcc

SEQ ID NO: 9651 - RNA, 27 nt, Artificial Sequence
  Synthetic Oligonucleotide
agaagguagcacuggagagaauuggaa

SEQ ID NO: 9652 - RNA, 27 nt, Artificial Sequence
  Synthetic Oligonucleotide
acacuaaggugaaaagauaaugaucuc

SEQ ID NO: 9653 - RNA, 27 nt, Artificial Sequence
  Synthetic Oligonucleotide
auaauauugcagcauuuuccagaugga

SEQ ID NO: 9654 - RNA, 27 nt, Artificial Sequence
  Synthetic Oligonucleotide
aaagaaauggacuuucauccuggaaau

SEQ ID NO: 9655 - RNA, 27 nt, Artificial Sequence
  Synthetic Oligonucleotide
ucuuagagagaaauaaagcauuuuugg

SEQ ID NO: 9656 - RNA, 27 nt, Artificial Sequence
  Synthetic Oligonucleotide
agugguucuuaaauuguaagcucaggu

SEQ ID NO: 9657 - RNA, 27 nt, Artificial Sequence
  Synthetic Oligonucleotide
cuuuaucauuuucuccugaggaaaauu

SEQ ID NO: 9658 - RNA, 27 nt, Artificial Sequence
  Synthetic Oligonucleotide
gauacuucuuugaauguagauuuccaa

SEQ ID NO: 9659 - RNA, 27 nt, Artificial Sequence
  Synthetic Oligonucleotide
guucuuaaauuguaagcucagguucaa

SEQ ID NO: 9660 - RNA, 27 nt, Artificial Sequence
  Synthetic Oligonucleotide
acaugcuaaaucaguacuuccaaaguc

SEQ ID NO: 9661 - RNA, 27 nt, Artificial Sequence
  Synthetic Oligonucleotide
ggaauguugcugaaacagaucugucga

SEQ ID NO: 9662 - RNA, 27 nt, Artificial Sequence
  Synthetic Oligonucleotide
auuguaagcucagguucaaaguguugg

SEQ ID NO: 9663 - RNA, 27 nt, Artificial Sequence
  Synthetic Oligonucleotide
agaucugucgacuucuguuuuaggaca

SEQ ID NO: 9664 - RNA, 27 nt, Artificial Sequence
  Synthetic Oligonucleotide
cuacaaggccauauuugugacagugga

SEQ ID NO: 9665 - RNA, 27 nt, Artificial Sequence
  Synthetic Oligonucleotide
uacaugucuuuaaaacagugguucuua

SEQ ID NO: 9666 - RNA, 27 nt, Artificial Sequence
  Synthetic Oligonucleotide
guaauuccccacuucaauacaaagggu

SEQ ID NO: 9667 - RNA, 27 nt, Artificial Sequence
  Synthetic Oligonucleotide
gucuggaugaugugcguaacagauuca

SEQ ID NO: 9668 - RNA, 27 nt, Artificial Sequence
  Synthetic Oligonucleotide
uggagguagcaaacacuaaggugaaaa

SEQ ID NO: 9669 - RNA, 27 nt, Artificial Sequence
  Synthetic Oligonucleotide
uucuuagagagaaauaaagcauuuuug

SEQ ID NO: 9670 - RNA, 27 nt, Artificial Sequence
  Synthetic Oligonucleotide
auguuuuaggauguauguuacuucuua

SEQ ID NO: 9671 - RNA, 27 nt, Artificial Sequence
  Synthetic Oligonucleotide
auguccucgagauacuaaaggaagaau

SEQ ID NO: 9672 - RNA, 27 nt, Artificial Sequence
  Synthetic Oligonucleotide
gccugauucacaacuuugagaagguag

SEQ ID NO: 9673 - RNA, 27 nt, Artificial Sequence
  Synthetic Oligonucleotide
uucuguuuacaugucuuuaaaacagug

SEQ ID NO: 9674 - RNA, 27 nt, Artificial Sequence
  Synthetic Oligonucleotide
aagauaucaaauggcugagaagacuga

SEQ ID NO: 9675 - RNA, 27 nt, Artificial Sequence
  Synthetic Oligonucleotide
uuuggcugauaauauugcagcauuuuc

SEQ ID NO: 9676 - RNA, 27 nt, Artificial Sequence
  Synthetic Oligonucleotide
uccagauggaagcuguauccaaggaug

SEQ ID NO: 9677 - RNA, 27 nt, Artificial Sequence
  Synthetic Oligonucleotide
acuucguuggcugcaacuguauaucua

SEQ ID NO: 9678 - RNA, 27 nt, Artificial Sequence
  Synthetic Oligonucleotide
gaagguagcacuggagagaauuggaau

SEQ ID NO: 9679 - RNA, 27 nt, Artificial Sequence
  Synthetic Oligonucleotide
aauguugcugaaacagaucugucgacu

SEQ ID NO: 9680 - RNA, 27 nt, Artificial Sequence
  Synthetic Oligonucleotide
cguuggcugcaacuguauaucuacaag

SEQ ID NO: 9681 - RNA, 27 nt, Artificial Sequence
  Synthetic Oligonucleotide
uuagaaagaaauggacuuucauccugg

SEQ ID NO: 9682 - RNA, 27 nt, Artificial Sequence
  Synthetic Oligonucleotide
agugcacaauauuuucccaucuguauu

SEQ ID NO: 9683 - RNA, 27 nt, Artificial Sequence
  Synthetic Oligonucleotide
cagugcacaauauuuucccaucuguau

SEQ ID NO: 9684 - RNA, 27 nt, Artificial Sequence
  Synthetic Oligonucleotide
gauucacaacuuugagaagguagcacu

SEQ ID NO: 9685 - RNA, 27 nt, Artificial Sequence
  Synthetic Oligonucleotide
gaugcuccggaauguugcugaaacaga

SEQ ID NO: 9686 - RNA, 27 nt, Artificial Sequence
  Synthetic Oligonucleotide
cuucaauacaaagggugucguucuuuu

SEQ ID NO: 9687 - RNA, 27 nt, Artificial Sequence
  Synthetic Oligonucleotide
ugcaacuguauaucuacaaggaccgag

SEQ ID NO: 9688 - RNA, 27 nt, Artificial Sequence
  Synthetic Oligonucleotide
uuugaauguagauuuccaaucacaucu

SEQ ID NO: 9689 - RNA, 27 nt, Artificial Sequence
  Synthetic Oligonucleotide
ggauguauguuacuucuuagagagaaa

SEQ ID NO: 9690 - RNA, 27 nt, Artificial Sequence
  Synthetic Oligonucleotide
aauguuuuaggauguauguuacuucuu

SEQ ID NO: 9691 - RNA, 27 nt, Artificial Sequence
  Synthetic Oligonucleotide
gaugaugugcguaacagauucaaacug

SEQ ID NO: 9692 - RNA, 27 nt, Artificial Sequence
  Synthetic Oligonucleotide
uuaguaaaauuggagguagcaaacacu

SEQ ID NO: 9693 - RNA, 27 nt, Artificial Sequence
  Synthetic Oligonucleotide
agguguucaagauguccucgagauacu

SEQ ID NO: 9694 - RNA, 27 nt, Artificial Sequence
  Synthetic Oligonucleotide
uuacuucuuagagagaaauaaagcauu

SEQ ID NO: 9695 - RNA, 27 nt, Artificial Sequence
  Synthetic Oligonucleotide
ugacagugcacaauauuuucccaucug

SEQ ID NO: 9696 - RNA, 27 nt, Artificial Sequence
  Synthetic Oligonucleotide
aagguguucaagauguccucgagauac

SEQ ID NO: 9697 - RNA, 27 nt, Artificial Sequence
  Synthetic Oligonucleotide
auguuacuucuuagagagaaauaaagc

SEQ ID NO: 9698 - RNA, 27 nt, Artificial Sequence
  Synthetic Oligonucleotide
aauacaaagggugucguucuuuuccaa

SEQ ID NO: 9699 - RNA, 27 nt, Artificial Sequence
  Synthetic Oligonucleotide
acaugucuuuaaaacagugguucuuaa

SEQ ID NO: 9700 - RNA, 27 nt, Artificial Sequence
  Synthetic Oligonucleotide
gcagagggugaccacagucuguaauuc

SEQ ID NO: 9701 - RNA, 27 nt, Artificial Sequence
  Synthetic Oligonucleotide
ccaaggaugcuccggaauguugcugaa

SEQ ID NO: 9702 - RNA, 27 nt, Artificial Sequence
  Synthetic Oligonucleotide
agagagaaauaaagcauuuuugggaag

SEQ ID NO: 9703 - RNA, 27 nt, Artificial Sequence
  Synthetic Oligonucleotide
ucuuugaauguagauuuccaaucacau

SEQ ID NO: 9704 - RNA, 27 nt, Artificial Sequence
  Synthetic Oligonucleotide
cuguuuacaugucuuuaaaacaguggu

SEQ ID NO: 9705 - RNA, 27 nt, Artificial Sequence
  Synthetic Oligonucleotide
aauuggagguagcaaacacuaagguga

SEQ ID NO: 9706 - RNA, 27 nt, Artificial Sequence
  Synthetic Oligonucleotide
cuaaagcaauagacccaucuaucagcu

SEQ ID NO: 9707 - RNA, 27 nt, Artificial Sequence
  Synthetic Oligonucleotide
caacaugcuaaaucaguacuuccaaag

SEQ ID NO: 9708 - RNA, 27 nt, Artificial Sequence
  Synthetic Oligonucleotide
uacuucuuugaauguagauuuccaauc

SEQ ID NO: 9709 - RNA, 27 nt, Artificial Sequence
  Synthetic Oligonucleotide
ugccaauuguugcaaagggcauuuuga

SEQ ID NO: 9710 - RNA, 27 nt, Artificial Sequence
  Synthetic Oligonucleotide
ggcuaaagugcuguauccuuuaguaaa

SEQ ID NO: 9711 - RNA, 27 nt, Artificial Sequence
  Synthetic Oligonucleotide
guauuacuugacaaagagacacugugc

SEQ ID NO: 9712 - RNA, 27 nt, Artificial Sequence
  Synthetic Oligonucleotide
gguucuuaaauuguaagcucagguuca

SEQ ID NO: 9713 - RNA, 27 nt, Artificial Sequence
  Synthetic Oligonucleotide
ugaaacagaucugucgacuucuguuuu

SEQ ID NO: 9714 - RNA, 27 nt, Artificial Sequence
  Synthetic Oligonucleotide
gauaauauugcagcauuuuccagaugg

SEQ ID NO: 9715 - RNA, 27 nt, Artificial Sequence
  Synthetic Oligonucleotide
cugauucacaacuuugagaagguagca

SEQ ID NO: 9716 - RNA, 27 nt, Artificial Sequence
  Synthetic Oligonucleotide
cugcauauguggcuaaagcaauagacc

SEQ ID NO: 9717 - RNA, 27 nt, Artificial Sequence
  Synthetic Oligonucleotide
aagggugucguucuuuuccaacaaaau

SEQ ID NO: 9718 - RNA, 27 nt, Artificial Sequence
  Synthetic Oligonucleotide
aaccgucuggaugaugugcguaacaga

SEQ ID NO: 9719 - RNA, 27 nt, Artificial Sequence
  Synthetic Oligonucleotide
ccuaggaaccuuuuagaaagaaaugga

SEQ ID NO: 9720 - RNA, 27 nt, Artificial Sequence
  Synthetic Oligonucleotide
cagccacuauugauguucugccagaaa

SEQ ID NO: 9721 - RNA, 27 nt, Artificial Sequence
  Synthetic Oligonucleotide
uucaauacaaagggugucguucuuuuc

SEQ ID NO: 9722 - RNA, 27 nt, Artificial Sequence
  Synthetic Oligonucleotide
cuucuuugaauguagauuuccaaucac

SEQ ID NO: 9723 - RNA, 27 nt, Artificial Sequence
  Synthetic Oligonucleotide
cuucguuggcugcaacuguauaucuac

SEQ ID NO: 9724 - RNA, 27 nt, Artificial Sequence
  Synthetic Oligonucleotide
uagcaauaaccugugaaaaugcucccc

SEQ ID NO: 9725 - RNA, 27 nt, Artificial Sequence
  Synthetic Oligonucleotide
aaagucuauauaugacuauuacagguc

SEQ ID NO: 9726 - RNA, 27 nt, Artificial Sequence
  Synthetic Oligonucleotide
aucauuuucuccugaggaaaauuuugg

SEQ ID NO: 9727 - RNA, 27 nt, Artificial Sequence
  Synthetic Oligonucleotide
ugcauauguggcuaaagcaauagaccc

SEQ ID NO: 9728 - RNA, 27 nt, Artificial Sequence
  Synthetic Oligonucleotide
gacgacaguggacuugcugcauaugug

SEQ ID NO: 9729 - RNA, 27 nt, Artificial Sequence
  Synthetic Oligonucleotide
guuuccaagaucugacagugcacaaua

SEQ ID NO: 9730 - RNA, 27 nt, Artificial Sequence
  Synthetic Oligonucleotide
aaaugaugaagaaacuuuggcugauaa

SEQ ID NO: 9731 - RNA, 27 nt, Artificial Sequence
  Synthetic Oligonucleotide
cagagggugaccacagucuguaauucc

SEQ ID NO: 9732 - RNA, 27 nt, Artificial Sequence
  Synthetic Oligonucleotide
agagaaauaaagcauuuuugggaagaa

SEQ ID NO: 9733 - RNA, 27 nt, Artificial Sequence
  Synthetic Oligonucleotide
uugaaugggaucuuggugucgaaucau

SEQ ID NO: 9734 - RNA, 27 nt, Artificial Sequence
  Synthetic Oligonucleotide
cuguaauuccccacuucaauacaaagg

SEQ ID NO: 9735 - RNA, 27 nt, Artificial Sequence
  Synthetic Oligonucleotide
ugcuguauccuuuaguaaaauuggagg

SEQ ID NO: 9736 - RNA, 27 nt, Artificial Sequence
  Synthetic Oligonucleotide
gagaagguagcacuggagagaauugga

SEQ ID NO: 9737 - RNA, 27 nt, Artificial Sequence
  Synthetic Oligonucleotide
ccagccacuauugauguucugccagaa

SEQ ID NO: 9738 - RNA, 27 nt, Artificial Sequence
  Synthetic Oligonucleotide
cugacagugcacaauauuuucccaucu

SEQ ID NO: 9739 - RNA, 27 nt, Artificial Sequence
  Synthetic Oligonucleotide
uguccuaggaaccuuuuagaaagaaau

SEQ ID NO: 9740 - RNA, 27 nt, Artificial Sequence
  Synthetic Oligonucleotide
ugaaugggaucuuggugucgaaucaug

SEQ ID NO: 9741 - RNA, 27 nt, Artificial Sequence
  Synthetic Oligonucleotide
agagggugaccacagucuguaauuccc

SEQ ID NO: 9742 - RNA, 27 nt, Artificial Sequence
  Synthetic Oligonucleotide
agaucugacagugcacaauauuuuccc

SEQ ID NO: 9743 - RNA, 27 nt, Artificial Sequence
  Synthetic Oligonucleotide
guacuuccaaagucuauauaugacuau

SEQ ID NO: 9744 - RNA, 27 nt, Artificial Sequence
  Synthetic Oligonucleotide
uuuagaaagaaauggacuuucauccug

SEQ ID NO: 9745 - RNA, 27 nt, Artificial Sequence
  Synthetic Oligonucleotide
gagugggugccagaaugugaaagucau

SEQ ID NO: 9746 - RNA, 27 nt, Artificial Sequence
  Synthetic Oligonucleotide
cugaggaaaauuuuggagacgacagug

SEQ ID NO: 9747 - RNA, 27 nt, Artificial Sequence
  Synthetic Oligonucleotide
uggggugccagccacuauugauguucu

SEQ ID NO: 9748 - RNA, 27 nt, Artificial Sequence
  Synthetic Oligonucleotide
ccccggcuaauuuguaucaaugauuau

SEQ ID NO: 9749 - RNA, 27 nt, Artificial Sequence
  Synthetic Oligonucleotide
ugcagagggugaccacagucuguaauu

SEQ ID NO: 9750 - RNA, 27 nt, Artificial Sequence
  Synthetic Oligonucleotide
acaaggccauauuugugacaguggaca

SEQ ID NO: 9751 - RNA, 27 nt, Artificial Sequence
  Synthetic Oligonucleotide
gucuuuaaaacagugguucuuaaauug

SEQ ID NO: 9752 - RNA, 27 nt, Artificial Sequence
  Synthetic Oligonucleotide
uccucgagauacuaaaggaagaauucc

SEQ ID NO: 9753 - RNA, 27 nt, Artificial Sequence
  Synthetic Oligonucleotide
aaagcaauagacccaucuaucagcugg

SEQ ID NO: 9754 - RNA, 27 nt, Artificial Sequence
  Synthetic Oligonucleotide
gcauuuuccagauggaagcuguaucca

SEQ ID NO: 9755 - RNA, 27 nt, Artificial Sequence
  Synthetic Oligonucleotide
caugcuaaaucaguacuuccaaagucu

SEQ ID NO: 9756 - RNA, 27 nt, Artificial Sequence
  Synthetic Oligonucleotide
ccuuuuagaaagaaauggacuuucauc

SEQ ID NO: 9757 - RNA, 27 nt, Artificial Sequence
  Synthetic Oligonucleotide
aguacuuuaucauuuucuccugaggaa

SEQ ID NO: 9758 - RNA, 27 nt, Artificial Sequence
  Synthetic Oligonucleotide
cuaaaucaguacuuccaaagucuauau

SEQ ID NO: 9759 - RNA, 27 nt, Artificial Sequence
  Synthetic Oligonucleotide
aacagaucugucgacuucuguuuuagg

SEQ ID NO: 9760 - RNA, 27 nt, Artificial Sequence
  Synthetic Oligonucleotide
aagacauuggugaggaaaaauccuuug

SEQ ID NO: 9761 - RNA, 27 nt, Artificial Sequence
  Synthetic Oligonucleotide
uuuccaacaaaauagcaaucccuuuua

SEQ ID NO: 9762 - RNA, 27 nt, Artificial Sequence
  Synthetic Oligonucleotide
aaacagaucugucgacuucuguuuuag

SEQ ID NO: 9763 - RNA, 27 nt, Artificial Sequence
  Synthetic Oligonucleotide
caacuguauaucuacaaggaccgagaa

SEQ ID NO: 9764 - RNA, 27 nt, Artificial Sequence
  Synthetic Oligonucleotide
ccugauucacaacuuugagaagguagc

SEQ ID NO: 9765 - RNA, 27 nt, Artificial Sequence
  Synthetic Oligonucleotide
gaaacuuuggcugauaauauugcagca

SEQ ID NO: 9766 - RNA, 27 nt, Artificial Sequence
  Synthetic Oligonucleotide
uuccaaucacaucuuuagugucugaau

SEQ ID NO: 9767 - RNA, 27 nt, Artificial Sequence
  Synthetic Oligonucleotide
augcuccggaauguugcugaaacagau

SEQ ID NO: 9768 - RNA, 27 nt, Artificial Sequence
  Synthetic Oligonucleotide
uguaauuccccacuucaauacaaaggg

SEQ ID NO: 9769 - RNA, 27 nt, Artificial Sequence
  Synthetic Oligonucleotide
gaaccuuuuagaaagaaauggacuuuc

SEQ ID NO: 9770 - RNA, 27 nt, Artificial Sequence
  Synthetic Oligonucleotide
gguguucaagauguccucgagauacua

SEQ ID NO: 9771 - RNA, 27 nt, Artificial Sequence
  Synthetic Oligonucleotide
uaauuccccacuucaauacaaagggug

SEQ ID NO: 9772 - RNA, 27 nt, Artificial Sequence
  Synthetic Oligonucleotide
uggcugcaacuguauaucuacaaggac

SEQ ID NO: 9773 - RNA, 27 nt, Artificial Sequence
  Synthetic Oligonucleotide
augucuuuaaaacagugguucuuaaau

SEQ ID NO: 9774 - RNA, 27 nt, Artificial Sequence
  Synthetic Oligonucleotide
ggacagagggucagcaugccaauaugu

SEQ ID NO: 9775 - RNA, 27 nt, Artificial Sequence
  Synthetic Oligonucleotide
aagauguccucgagauacuaaaggaag

SEQ ID NO: 9776 - RNA, 27 nt, Artificial Sequence
  Synthetic Oligonucleotide
uggcgguaauuggugauacuucuuuga

SEQ ID NO: 9777 - RNA, 27 nt, Artificial Sequence
  Synthetic Oligonucleotide
cuucuuagagagaaauaaagcauuuuu

SEQ ID NO: 9778 - RNA, 27 nt, Artificial Sequence
  Synthetic Oligonucleotide
guaaaauuggagguagcaaacacuaag

SEQ ID NO: 9779 - RNA, 27 nt, Artificial Sequence
  Synthetic Oligonucleotide
ugucuuuaaaacagugguucuuaaauu

SEQ ID NO: 9780 - RNA, 27 nt, Artificial Sequence
  Synthetic Oligonucleotide
uaggauguauguuacuucuuagagaga

SEQ ID NO: 9781 - RNA, 27 nt, Artificial Sequence
  Synthetic Oligonucleotide
cuguauccuuuaguaaaauuggaggua

SEQ ID NO: 9782 - RNA, 27 nt, Artificial Sequence
  Synthetic Oligonucleotide
cagcauuuuccagauggaagcuguauc

SEQ ID NO: 9783 - RNA, 27 nt, Artificial Sequence
  Synthetic Oligonucleotide
ucacaacuuugagaagguagcacugga

SEQ ID NO: 9784 - RNA, 27 nt, Artificial Sequence
  Synthetic Oligonucleotide
guucuuuuccaacaaaauagcaauccc

SEQ ID NO: 9785 - RNA, 27 nt, Artificial Sequence
  Synthetic Oligonucleotide
cugagugggugccagaaugugaaaguc

SEQ ID NO: 9786 - RNA, 27 nt, Artificial Sequence
  Synthetic Oligonucleotide
uaucaaauggcugagaagacugacauc

SEQ ID NO: 9787 - RNA, 27 nt, Artificial Sequence
  Synthetic Oligonucleotide
ugccgccacaacucaggaugaaaaauu

SEQ ID NO: 9788 - RNA, 27 nt, Artificial Sequence
  Synthetic Oligonucleotide
aaggaugcuccggaauguugcugaaac

SEQ ID NO: 9789 - RNA, 27 nt, Artificial Sequence
  Synthetic Oligonucleotide
ggagguagcaaacacuaaggugaaaag

SEQ ID NO: 9790 - RNA, 27 nt, Artificial Sequence
  Synthetic Oligonucleotide
ccacagucuguaauuccccacuucaau

SEQ ID NO: 9791 - RNA, 27 nt, Artificial Sequence
  Synthetic Oligonucleotide
gaauguugcugaaacagaucugucgac

SEQ ID NO: 9792 - RNA, 27 nt, Artificial Sequence
  Synthetic Oligonucleotide
gcuaaaucaguacuuccaaagucuaua

SEQ ID NO: 9793 - RNA, 27 nt, Artificial Sequence
  Synthetic Oligonucleotide
gcaacuguauaucuacaaggaccgaga

SEQ ID NO: 9794 - RNA, 27 nt, Artificial Sequence
  Synthetic Oligonucleotide
aacaugcuaaaucaguacuuccaaagu

SEQ ID NO: 9795 - RNA, 27 nt, Artificial Sequence
  Synthetic Oligonucleotide
agauaucaaauggcugagaagacugac

SEQ ID NO: 9796 - RNA, 27 nt, Artificial Sequence
  Synthetic Oligonucleotide
uacuucuuagagagaaauaaagcauuu

SEQ ID NO: 9797 - RNA, 27 nt, Artificial Sequence
  Synthetic Oligonucleotide
accgucuggaugaugugcguaacagau

SEQ ID NO: 9798 - RNA, 27 nt, Artificial Sequence
  Synthetic Oligonucleotide
uugccaauuguugcaaagggcauuuug

SEQ ID NO: 9799 - RNA, 27 nt, Artificial Sequence
  Synthetic Oligonucleotide
uacaaagggugucguucuuuuccaaca

SEQ ID NO: 9800 - RNA, 27 nt, Artificial Sequence
  Synthetic Oligonucleotide
agucaucgacaagacauuggugaggaa

SEQ ID NO: 9801 - RNA, 27 nt, Artificial Sequence
  Synthetic Oligonucleotide
acuuuggcugauaauauugcagcauuu

SEQ ID NO: 9802 - RNA, 27 nt, Artificial Sequence
  Synthetic Oligonucleotide
gacuugcugcauauguggcuaaagcaa

SEQ ID NO: 9803 - RNA, 27 nt, Artificial Sequence
  Synthetic Oligonucleotide
ucuuuuccaacaaaauagcaaucccuu

SEQ ID NO: 9804 - RNA, 27 nt, Artificial Sequence
  Synthetic Oligonucleotide
cccacuucaauacaaagggugucguuc

SEQ ID NO: 9805 - RNA, 27 nt, Artificial Sequence
  Synthetic Oligonucleotide
uauauccaaauguuuuaggauguaugu

SEQ ID NO: 9806 - RNA, 27 nt, Artificial Sequence
  Synthetic Oligonucleotide
caucuaucagcugggaagauaucaaau

SEQ ID NO: 9807 - RNA, 27 nt, Artificial Sequence
  Synthetic Oligonucleotide
acgacaguggacuugcugcauaugugg

SEQ ID NO: 9808 - RNA, 27 nt, Artificial Sequence
  Synthetic Oligonucleotide
guguccuaggaaccuuuuagaaagaaa

SEQ ID NO: 9809 - RNA, 27 nt, Artificial Sequence
  Synthetic Oligonucleotide
gaccacagucuguaauuccccacuuca

SEQ ID NO: 9810 - RNA, 27 nt, Artificial Sequence
  Synthetic Oligonucleotide
caaccgucuggaugaugugcguaacag

SEQ ID NO: 9811 - RNA, 27 nt, Artificial Sequence
  Synthetic Oligonucleotide
ggcugcaacuguauaucuacaaggacc

SEQ ID NO: 9812 - RNA, 27 nt, Artificial Sequence
  Synthetic Oligonucleotide
uccaaggaugcuccggaauguugcuga

SEQ ID NO: 9813 - RNA, 27 nt, Artificial Sequence
  Synthetic Oligonucleotide
caaggaugcuccggaauguugcugaaa

SEQ ID NO: 9814 - RNA, 27 nt, Artificial Sequence
  Synthetic Oligonucleotide
auguugcugaaacagaucugucgacuu

SEQ ID NO: 9815 - RNA, 27 nt, Artificial Sequence
  Synthetic Oligonucleotide
caaagggcauuuugagaggugaugaug

SEQ ID NO: 9816 - RNA, 27 nt, Artificial Sequence
  Synthetic Oligonucleotide
gcuaaagcaauagacccaucuaucagc

SEQ ID NO: 9817 - RNA, 27 nt, Artificial Sequence
  Synthetic Oligonucleotide
uucaagauguccucgagauacuaaagg

SEQ ID NO: 9818 - RNA, 27 nt, Artificial Sequence
  Synthetic Oligonucleotide
gugaccacagucuguaauuccccacuu

SEQ ID NO: 9819 - RNA, 27 nt, Artificial Sequence
  Synthetic Oligonucleotide
gaaagucaucgacaagacauuggugag

SEQ ID NO: 9820 - RNA, 27 nt, Artificial Sequence
  Synthetic Oligonucleotide
ugggaagauaucaaauggcugagaaga

SEQ ID NO: 9821 - RNA, 27 nt, Artificial Sequence
  Synthetic Oligonucleotide
cuccugaggaaaauuuuggagacgaca

SEQ ID NO: 9822 - RNA, 27 nt, Artificial Sequence
  Synthetic Oligonucleotide
uugauguucugccagaaauuguggagg

SEQ ID NO: 9823 - RNA, 27 nt, Artificial Sequence
  Synthetic Oligonucleotide
ugccagccacuauugauguucugccag

SEQ ID NO: 9824 - RNA, 27 nt, Artificial Sequence
  Synthetic Oligonucleotide
acaaagggugucguucuuuuccaacaa

SEQ ID NO: 9825 - RNA, 27 nt, Artificial Sequence
  Synthetic Oligonucleotide
caucgacaagacauuggugaggaaaaa

SEQ ID NO: 9826 - RNA, 27 nt, Artificial Sequence
  Synthetic Oligonucleotide
ggaaaggcacugauguucugaaagcuc

SEQ ID NO: 9827 - RNA, 27 nt, Artificial Sequence
  Synthetic Oligonucleotide
agggugaccacagucuguaauucccca

SEQ ID NO: 9828 - RNA, 27 nt, Artificial Sequence
  Synthetic Oligonucleotide
gccgccacaacucaggaugaaaaauuu

SEQ ID NO: 9829 - RNA, 27 nt, Artificial Sequence
  Synthetic Oligonucleotide
guggcgguaauuggugauacuucuuug

SEQ ID NO: 9830 - RNA, 27 nt, Artificial Sequence
  Synthetic Oligonucleotide
auugcuuuugacuuuucaauggguguc

SEQ ID NO: 9831 - RNA, 27 nt, Artificial Sequence
  Synthetic Oligonucleotide
caauggguguccuaggaaccuuuuaga

SEQ ID NO: 9832 - RNA, 27 nt, Artificial Sequence
  Synthetic Oligonucleotide
auuggagguagcaaacacuaaggugaa

SEQ ID NO: 9833 - RNA, 27 nt, Artificial Sequence
  Synthetic Oligonucleotide
gcugaaacagaucugucgacuucuguu

SEQ ID NO: 9834 - RNA, 27 nt, Artificial Sequence
  Synthetic Oligonucleotide
uacaaggccauauuugugacaguggac

SEQ ID NO: 9835 - RNA, 27 nt, Artificial Sequence
  Synthetic Oligonucleotide
auugcagcauuuuccagauggaagcug

SEQ ID NO: 9836 - RNA, 27 nt, Artificial Sequence
  Synthetic Oligonucleotide
ugcuaaaucaguacuuccaaagucuau

SEQ ID NO: 9837 - RNA, 27 nt, Artificial Sequence
  Synthetic Oligonucleotide
cagugguucuuaaauuguaagcucagg

SEQ ID NO: 9838 - RNA, 27 nt, Artificial Sequence
  Synthetic Oligonucleotide
cauugcuuuugacuuuucaaugggugu

SEQ ID NO: 9839 - RNA, 27 nt, Artificial Sequence
  Synthetic Oligonucleotide
gagagaaauaaagcauuuuugggaaga

SEQ ID NO: 9840 - RNA, 27 nt, Artificial Sequence
  Synthetic Oligonucleotide
auguagauuuccaaucacaucuuuagu

SEQ ID NO: 9841 - RNA, 27 nt, Artificial Sequence
  Synthetic Oligonucleotide
uuccagauggaagcuguauccaaggau

SEQ ID NO: 9842 - RNA, 27 nt, Artificial Sequence
  Synthetic Oligonucleotide
caauuguugcaaagggcauuuugagag

SEQ ID NO: 9843 - RNA, 27 nt, Artificial Sequence
  Synthetic Oligonucleotide
aucuacaaggaccgagaagucaccaag

SEQ ID NO: 9844 - RNA, 27 nt, Artificial Sequence
  Synthetic Oligonucleotide
uuugagaagguagcacuggagagaauu

SEQ ID NO: 9845 - RNA, 27 nt, Artificial Sequence
  Synthetic Oligonucleotide
uuggagguagcaaacacuaaggugaaa

SEQ ID NO: 9846 - RNA, 27 nt, Artificial Sequence
  Synthetic Oligonucleotide
acaaggaccgagaagucaccaagaagc

SEQ ID NO: 9847 - RNA, 27 nt, Artificial Sequence
  Synthetic Oligonucleotide
ggcuacaaggccauauuugugacagug

SEQ ID NO: 9848 - RNA, 27 nt, Artificial Sequence
  Synthetic Oligonucleotide
ccaguacuuuaucauuuucuccugagg

SEQ ID NO: 9849 - RNA, 27 nt, Artificial Sequence
  Synthetic Oligonucleotide
uagauuuccaaucacaucuuuaguguc

SEQ ID NO: 9850 - RNA, 27 nt, Artificial Sequence
  Synthetic Oligonucleotide
uuuaggauguauguuacuucuuagaga

SEQ ID NO: 9851 - RNA, 27 nt, Artificial Sequence
  Synthetic Oligonucleotide
acuuuaucauuuucuccugaggaaaau

SEQ ID NO: 9852 - RNA, 27 nt, Artificial Sequence
  Synthetic Oligonucleotide
cgucuggaugaugugcguaacagauuc

SEQ ID NO: 9853 - RNA, 27 nt, Artificial Sequence
  Synthetic Oligonucleotide
acuguauaucuacaaggaccgagaagu

SEQ ID NO: 9854 - RNA, 27 nt, Artificial Sequence
  Synthetic Oligonucleotide
caaaugaugaagaaacuuuggcugaua

SEQ ID NO: 9855 - RNA, 27 nt, Artificial Sequence
  Synthetic Oligonucleotide
cagaucugucgacuucuguuuuaggac

SEQ ID NO: 9856 - RNA, 27 nt, Artificial Sequence
  Synthetic Oligonucleotide
aagguagcacuggagagaauuggaaug

SEQ ID NO: 9857 - RNA, 27 nt, Artificial Sequence
  Synthetic Oligonucleotide
gaaagaaauggacuuucauccuggaaa

SEQ ID NO: 9858 - RNA, 27 nt, Artificial Sequence
  Synthetic Oligonucleotide
gaaaggcacugauguucugaaagcucu

SEQ ID NO: 9859 - RNA, 27 nt, Artificial Sequence
  Synthetic Oligonucleotide
aauggcugagaagacugacaucauugc

SEQ ID NO: 9860 - RNA, 27 nt, Artificial Sequence
  Synthetic Oligonucleotide
gccagccacuauugauguucugccaga

SEQ ID NO: 9861 - RNA, 27 nt, Artificial Sequence
  Synthetic Oligonucleotide
cugcaacuguauaucuacaaggaccga

SEQ ID NO: 9862 - RNA, 27 nt, Artificial Sequence
  Synthetic Oligonucleotide
agaaagguguucaagauguccucgaga

SEQ ID NO: 9863 - RNA, 27 nt, Artificial Sequence
  Synthetic Oligonucleotide
uguuuuaggauguauguuacuucuuag

SEQ ID NO: 9864 - RNA, 27 nt, Artificial Sequence
  Synthetic Oligonucleotide
uggguguccuaggaaccuuuuagaaag

SEQ ID NO: 9865 - RNA, 27 nt, Artificial Sequence
  Synthetic Oligonucleotide
gaaacagaucugucgacuucuguuuua

SEQ ID NO: 9866 - RNA, 27 nt, Artificial Sequence
  Synthetic Oligonucleotide
ggaagauaucaaauggcugagaagacu

SEQ ID NO: 9867 - RNA, 27 nt, Artificial Sequence
  Synthetic Oligonucleotide
auauugcagcauuuuccagauggaagc

SEQ ID NO: 9868 - RNA, 27 nt, Artificial Sequence
  Synthetic Oligonucleotide
ucaauacaaagggugucguucuuuucc

SEQ ID NO: 9869 - RNA, 27 nt, Artificial Sequence
  Synthetic Oligonucleotide
ugacuuuucaauggguguccuaggaac

SEQ ID NO: 9870 - RNA, 27 nt, Artificial Sequence
  Synthetic Oligonucleotide
uugcuuuugacuuuucaaugggugucc

SEQ ID NO: 9871 - RNA, 27 nt, Artificial Sequence
  Synthetic Oligonucleotide
uguugcugaaacagaucugucgacuuc

SEQ ID NO: 9872 - RNA, 27 nt, Artificial Sequence
  Synthetic Oligonucleotide
cggaauguugcugaaacagaucugucg

SEQ ID NO: 9873 - RNA, 27 nt, Artificial Sequence
  Synthetic Oligonucleotide
aggcuaaagugcuguauccuuuaguaa

SEQ ID NO: 9874 - RNA, 27 nt, Artificial Sequence
  Synthetic Oligonucleotide
caggcuaaagugcuguauccuuuagua

SEQ ID NO: 9875 - RNA, 27 nt, Artificial Sequence
  Synthetic Oligonucleotide
uugagaagguagcacuggagagaauug

SEQ ID NO: 9876 - RNA, 27 nt, Artificial Sequence
  Synthetic Oligonucleotide
guggcuaaagcaauagacccaucuauc

SEQ ID NO: 9877 - RNA, 27 nt, Artificial Sequence
  Synthetic Oligonucleotide
ccaauuguugcaaagggcauuuugaga

SEQ ID NO: 9878 - RNA, 27 nt, Artificial Sequence
  Synthetic Oligonucleotide
uuuaguaaaauuggagguagcaaacac

SEQ ID NO: 9879 - RNA, 27 nt, Artificial Sequence
  Synthetic Oligonucleotide
uguauaucuacaaggaccgagaaguca

SEQ ID NO: 9880 - RNA, 27 nt, Artificial Sequence
  Synthetic Oligonucleotide
cauauguggcuaaagcaauagacccau

SEQ ID NO: 9881 - RNA, 27 nt, Artificial Sequence
  Synthetic Oligonucleotide
aaauuggagguagcaaacacuaaggug

SEQ ID NO: 9882 - RNA, 27 nt, Artificial Sequence
  Synthetic Oligonucleotide
guauaucuacaaggaccgagaagucac

SEQ ID NO: 9883 - RNA, 27 nt, Artificial Sequence
  Synthetic Oligonucleotide
caguggacuugcugcauauguggcuaa

SEQ ID NO: 9884 - RNA, 27 nt, Artificial Sequence
  Synthetic Oligonucleotide
uguauccuuuaguaaaauuggagguag

SEQ ID NO: 9885 - RNA, 27 nt, Artificial Sequence
  Synthetic Oligonucleotide
auuacuugacaaagagacacugugcag

SEQ ID NO: 9886 - RNA, 27 nt, Artificial Sequence
  Synthetic Oligonucleotide
uugacuuuucaauggguguccuaggaa

SEQ ID NO: 9887 - RNA, 27 nt, Artificial Sequence
  Synthetic Oligonucleotide
uuuuagaaagaaauggacuuucauccu

SEQ ID NO: 9888 - RNA, 27 nt, Artificial Sequence
  Synthetic Oligonucleotide
ggaugcuccggaauguugcugaaacag

SEQ ID NO: 9889 - RNA, 27 nt, Artificial Sequence
  Synthetic Oligonucleotide
uagaaagaaauggacuuucauccugga

SEQ ID NO: 9890 - RNA, 27 nt, Artificial Sequence
  Synthetic Oligonucleotide
uguuuacaugucuuuaaaacagugguu

SEQ ID NO: 9891 - RNA, 27 nt, Artificial Sequence
  Synthetic Oligonucleotide
aaugaugaagaaacuuuggcugauaau

SEQ ID NO: 9892 - RNA, 27 nt, Artificial Sequence
  Synthetic Oligonucleotide
agacgacaguggacuugcugcauaugu

SEQ ID NO: 9893 - RNA, 27 nt, Artificial Sequence
  Synthetic Oligonucleotide
acagaucugucgacuucuguuuuagga

SEQ ID NO: 9894 - RNA, 27 nt, Artificial Sequence
  Synthetic Oligonucleotide
auauguggcuaaagcaauagacccauc

SEQ ID NO: 9895 - RNA, 27 nt, Artificial Sequence
  Synthetic Oligonucleotide
ugcggaaaggcacugauguucugaaag

SEQ ID NO: 9896 - RNA, 27 nt, Artificial Sequence
  Synthetic Oligonucleotide
gcugcauauguggcuaaagcaauagac

SEQ ID NO: 9897 - RNA, 27 nt, Artificial Sequence
  Synthetic Oligonucleotide
uggagacgacaguggacuugcugcaua

SEQ ID NO: 9898 - RNA, 27 nt, Artificial Sequence
  Synthetic Oligonucleotide
gugcagagggugaccacagucuguaau

SEQ ID NO: 9899 - RNA, 27 nt, Artificial Sequence
  Synthetic Oligonucleotide
ucuuuagugucugaauauauccaaaug

SEQ ID NO: 9900 - RNA, 27 nt, Artificial Sequence
  Synthetic Oligonucleotide
guucaagauguccucgagauacuaaag

SEQ ID NO: 9901 - RNA, 27 nt, Artificial Sequence
  Synthetic Oligonucleotide
aguaaaauuggagguagcaaacacuaa

SEQ ID NO: 9902 - RNA, 27 nt, Artificial Sequence
  Synthetic Oligonucleotide
auucacaacuuugagaagguagcacug

SEQ ID NO: 9903 - RNA, 27 nt, Artificial Sequence
  Synthetic Oligonucleotide
gauaucaaauggcugagaagacugaca

SEQ ID NO: 9904 - RNA, 27 nt, Artificial Sequence
  Synthetic Oligonucleotide
ggagaaagguguucaagauguccucga

SEQ ID NO: 9905 - RNA, 27 nt, Artificial Sequence
  Synthetic Oligonucleotide
guagauuuccaaucacaucuuuagugu

SEQ ID NO: 9906 - RNA, 27 nt, Artificial Sequence
  Synthetic Oligonucleotide
cuuugaauguagauuuccaaucacauc

SEQ ID NO: 9907 - RNA, 27 nt, Artificial Sequence
  Synthetic Oligonucleotide
uauugcagcauuuuccagauggaagcu

SEQ ID NO: 9908 - RNA, 27 nt, Artificial Sequence
  Synthetic Oligonucleotide
ccccacuucaauacaaagggugucguu

SEQ ID NO: 9909 - RNA, 27 nt, Artificial Sequence
  Synthetic Oligonucleotide
acuucuuugaauguagauuuccaauca

SEQ ID NO: 9910 - RNA, 27 nt, Artificial Sequence
  Synthetic Oligonucleotide
acuugcugcauauguggcuaaagcaau

SEQ ID NO: 9911 - RNA, 27 nt, Artificial Sequence
  Synthetic Oligonucleotide
aauggguguccuaggaaccuuuuagaa

SEQ ID NO: 9912 - RNA, 27 nt, Artificial Sequence
  Synthetic Oligonucleotide
ggcuaaagcaauagacccaucuaucag

SEQ ID NO: 9913 - RNA, 27 nt, Artificial Sequence
  Synthetic Oligonucleotide
ucgagauacuaaaggaagaauuccggu

SEQ ID NO: 9914 - RNA, 27 nt, Artificial Sequence
  Synthetic Oligonucleotide
ugugcggaaaggcacugauguucugaa

SEQ ID NO: 9915 - RNA, 27 nt, Artificial Sequence
  Synthetic Oligonucleotide
uuuuaggauguauguuacuucuuagag

SEQ ID NO: 9916 - RNA, 27 nt, Artificial Sequence
  Synthetic Oligonucleotide
gaggaaaauuuuggagacgacagugga

SEQ ID NO: 9917 - RNA, 27 nt, Artificial Sequence
  Synthetic Oligonucleotide
ccuuuaguaaaauuggagguagcaaac

SEQ ID NO: 9918 - RNA, 27 nt, Artificial Sequence
  Synthetic Oligonucleotide
aggacagagggucagcaugccaauaug

SEQ ID NO: 9919 - RNA, 27 nt, Artificial Sequence
  Synthetic Oligonucleotide
ucugucgacuucuguuuuaggacagag

SEQ ID NO: 9920 - RNA, 27 nt, Artificial Sequence
  Synthetic Oligonucleotide
guuuuaggauguauguuacuucuuaga

SEQ ID NO: 9921 - RNA, 27 nt, Artificial Sequence
  Synthetic Oligonucleotide
guagcacuggagagaauuggaaugggu

SEQ ID NO: 9922 - RNA, 27 nt, Artificial Sequence
  Synthetic Oligonucleotide
aaaauuggagguagcaaacacuaaggu

SEQ ID NO: 9923 - RNA, 27 nt, Artificial Sequence
  Synthetic Oligonucleotide
auggcugagaagacugacaucauugcc

SEQ ID NO: 9924 - RNA, 27 nt, Artificial Sequence
  Synthetic Oligonucleotide
uuuccaaucacaucuuuagugucugaa

SEQ ID NO: 9925 - RNA, 27 nt, Artificial Sequence
  Synthetic Oligonucleotide
acuucaauacaaagggugucguucuuu

SEQ ID NO: 9926 - RNA, 27 nt, Artificial Sequence
  Synthetic Oligonucleotide
cuguauaucuacaaggaccgagaaguc

SEQ ID NO: 9927 - RNA, 27 nt, Artificial Sequence
  Synthetic Oligonucleotide
ggacuugcugcauauguggcuaaagca

SEQ ID NO: 9928 - RNA, 27 nt, Artificial Sequence
  Synthetic Oligonucleotide
aaacuuuggcugauaauauugcagcau

SEQ ID NO: 9929 - RNA, 27 nt, Artificial Sequence
  Synthetic Oligonucleotide
aaauuuuggagacgacaguggacuugc

SEQ ID NO: 9930 - RNA, 27 nt, Artificial Sequence
  Synthetic Oligonucleotide
aucugucgacuucuguuuuaggacaga

SEQ ID NO: 9931 - RNA, 27 nt, Artificial Sequence
  Synthetic Oligonucleotide
gucuggggcaaaugaugaagaaacuuu

SEQ ID NO: 9932 - RNA, 27 nt, Artificial Sequence
  Synthetic Oligonucleotide
uucuccugaggaaaauuuuggagacga

SEQ ID NO: 9933 - RNA, 27 nt, Artificial Sequence
  Synthetic Oligonucleotide
uguggcuaaagcaauagacccaucuau

SEQ ID NO: 9934 - RNA, 27 nt, Artificial Sequence
  Synthetic Oligonucleotide
gacagagggucagcaugccaauaugug

SEQ ID NO: 9935 - RNA, 27 nt, Artificial Sequence
  Synthetic Oligonucleotide
cuuuugacuuuucaauggguguccuag

SEQ ID NO: 9936 - RNA, 27 nt, Artificial Sequence
  Synthetic Oligonucleotide
cggaaaggcacugauguucugaaagcu

SEQ ID NO: 9937 - RNA, 27 nt, Artificial Sequence
  Synthetic Oligonucleotide
accacagucuguaauuccccacuucaa

SEQ ID NO: 9938 - RNA, 27 nt, Artificial Sequence
  Synthetic Oligonucleotide
cuuuggcugauaauauugcagcauuuu

SEQ ID NO: 9939 - RNA, 27 nt, Artificial Sequence
  Synthetic Oligonucleotide
aggaaccuuuuagaaagaaauggacuu

SEQ ID NO: 9940 - RNA, 27 nt, Artificial Sequence
  Synthetic Oligonucleotide
guccucgagauacuaaaggaagaauuc

SEQ ID NO: 9941 - RNA, 27 nt, Artificial Sequence
  Synthetic Oligonucleotide
cgagauacuaaaggaagaauuccgguu

SEQ ID NO: 9942 - RNA, 27 nt, Artificial Sequence
  Synthetic Oligonucleotide
cccaucuaucagcugggaagauaucaa

SEQ ID NO: 9943 - RNA, 27 nt, Artificial Sequence
  Synthetic Oligonucleotide
ugcugaaacagaucugucgacuucugu

SEQ ID NO: 9944 - RNA, 27 nt, Artificial Sequence
  Synthetic Oligonucleotide
cuuuaguaaaauuggagguagcaaaca

SEQ ID NO: 9945 - RNA, 27 nt, Artificial Sequence
  Synthetic Oligonucleotide
agagacacugugcagagggugaccaca

SEQ ID NO: 9946 - RNA, 27 nt, Artificial Sequence
  Synthetic Oligonucleotide
auccuuuaguaaaauuggagguagcaa

SEQ ID NO: 9947 - RNA, 27 nt, Artificial Sequence
  Synthetic Oligonucleotide
gcagcauuuuccagauggaagcuguau

SEQ ID NO: 9948 - RNA, 27 nt, Artificial Sequence
  Synthetic Oligonucleotide
aacuguauaucuacaaggaccgagaag

SEQ ID NO: 9949 - RNA, 27 nt, Artificial Sequence
  Synthetic Oligonucleotide
gcuuuugacuuuucaauggguguccua

SEQ ID NO: 9950 - RNA, 27 nt, Artificial Sequence
  Synthetic Oligonucleotide
gcuaaagugcuguauccuuuaguaaaa

SEQ ID NO: 9951 - RNA, 27 nt, Artificial Sequence
  Synthetic Oligonucleotide
guccuaggaaccuuuuagaaagaaaug

SEQ ID NO: 9952 - RNA, 27 nt, Artificial Sequence
  Synthetic Oligonucleotide
aaagagacacugugcagagggugacca

SEQ ID NO: 9953 - RNA, 27 nt, Artificial Sequence
  Synthetic Oligonucleotide
auggguguccuaggaaccuuuuagaaa

SEQ ID NO: 9954 - RNA, 27 nt, Artificial Sequence
  Synthetic Oligonucleotide
agacccaucuaucagcugggaagauau

SEQ ID NO: 9955 - RNA, 27 nt, Artificial Sequence
  Synthetic Oligonucleotide
auuuucuccugaggaaaauuuuggaga

SEQ ID NO: 9956 - RNA, 27 nt, Artificial Sequence
  Synthetic Oligonucleotide
uaaagcaauagacccaucuaucagcug

SEQ ID NO: 9957 - RNA, 27 nt, Artificial Sequence
  Synthetic Oligonucleotide
auggggugccagccacuauugauguuc

SEQ ID NO: 9958 - RNA, 27 nt, Artificial Sequence
  Synthetic Oligonucleotide
cugaaacagaucugucgacuucuguuu

SEQ ID NO: 9959 - RNA, 27 nt, Artificial Sequence
  Synthetic Oligonucleotide
uccccacuucaauacaaagggugucgu

SEQ ID NO: 9960 - RNA, 27 nt, Artificial Sequence
  Synthetic Oligonucleotide
guuuacaugucuuuaaaacagugguuc

SEQ ID NO: 9961 - RNA, 27 nt, Artificial Sequence
  Synthetic Oligonucleotide
ugagaagguagcacuggagagaauugg

SEQ ID NO: 9962 - RNA, 27 nt, Artificial Sequence
  Synthetic Oligonucleotide
cuguauccaaggaugcuccggaauguu

SEQ ID NO: 9963 - RNA, 27 nt, Artificial Sequence
  Synthetic Oligonucleotide
ugcaaagggcauuuugagaggugauga

SEQ ID NO: 9964 - RNA, 27 nt, Artificial Sequence
  Synthetic Oligonucleotide
uggguggcgguaauuggugauacuucu

SEQ ID NO: 9965 - RNA, 27 nt, Artificial Sequence
  Synthetic Oligonucleotide
gccaauuguugcaaagggcauuuugag

SEQ ID NO: 9966 - RNA, 27 nt, Artificial Sequence
  Synthetic Oligonucleotide
aauguagauuuccaaucacaucuuuag

SEQ ID NO: 9967 - RNA, 27 nt, Artificial Sequence
  Synthetic Oligonucleotide
ugacaaagagacacugugcagagggug

SEQ ID NO: 9968 - RNA, 27 nt, Artificial Sequence
  Synthetic Oligonucleotide
uugcugaaacagaucugucgacuucug

SEQ ID NO: 9969 - RNA, 27 nt, Artificial Sequence
  Synthetic Oligonucleotide
uccugaggaaaauuuuggagacgacag

SEQ ID NO: 9970 - RNA, 27 nt, Artificial Sequence
  Synthetic Oligonucleotide
cuuagagagaaauaaagcauuuuuggg

SEQ ID NO: 9971 - RNA, 27 nt, Artificial Sequence
  Synthetic Oligonucleotide
uggcuaaagcaauagacccaucuauca

SEQ ID NO: 9972 - RNA, 27 nt, Artificial Sequence
  Synthetic Oligonucleotide
uccuaggaaccuuuuagaaagaaaugg

SEQ ID NO: 9973 - RNA, 27 nt, Artificial Sequence
  Synthetic Oligonucleotide
acaucauugccaauuguugcaaagggc

SEQ ID NO: 9974 - RNA, 27 nt, Artificial Sequence
  Synthetic Oligonucleotide
ccagauggaagcuguauccaaggaugc

SEQ ID NO: 9975 - RNA, 27 nt, Artificial Sequence
  Synthetic Oligonucleotide
cugugcagagggugaccacagucugua

SEQ ID NO: 9976 - RNA, 27 nt, Artificial Sequence
  Synthetic Oligonucleotide
agauggaagcuguauccaaggaugcuc

SEQ ID NO: 9977 - RNA, 27 nt, Artificial Sequence
  Synthetic Oligonucleotide
caucauugccaauuguugcaaagggca

SEQ ID NO: 9978 - RNA, 27 nt, Artificial Sequence
  Synthetic Oligonucleotide
aaagucaucgacaagacauuggugagg

SEQ ID NO: 9979 - RNA, 27 nt, Artificial Sequence
  Synthetic Oligonucleotide
auguggcuaaagcaauagacccaucua

SEQ ID NO: 9980 - RNA, 27 nt, Artificial Sequence
  Synthetic Oligonucleotide
ccgucuggaugaugugcguaacagauu

SEQ ID NO: 9981 - RNA, 27 nt, Artificial Sequence
  Synthetic Oligonucleotide
ugcuccggaauguugcugaaacagauc

SEQ ID NO: 9982 - RNA, 27 nt, Artificial Sequence
  Synthetic Oligonucleotide
uuuuccaacaaaauagcaaucccuuuu

SEQ ID NO: 9983 - RNA, 27 nt, Artificial Sequence
  Synthetic Oligonucleotide
cuuuuagaaagaaauggacuuucaucc

SEQ ID NO: 9984 - RNA, 27 nt, Artificial Sequence
  Synthetic Oligonucleotide
gcggaaaggcacugauguucugaaagc

SEQ ID NO: 9985 - RNA, 27 nt, Artificial Sequence
  Synthetic Oligonucleotide
gaaagguguucaagauguccucgagau

SEQ ID NO: 9986 - RNA, 27 nt, Artificial Sequence
  Synthetic Oligonucleotide
gagaaagguguucaagauguccucgag

SEQ ID NO: 9987 - RNA, 27 nt, Artificial Sequence
  Synthetic Oligonucleotide
auuguugcaaagggcauuuugagaggu

SEQ ID NO: 9988 - RNA, 27 nt, Artificial Sequence
  Synthetic Oligonucleotide
cguucuuuuccaacaaaauagcaaucc

SEQ ID NO: 9989 - RNA, 27 nt, Artificial Sequence
  Synthetic Oligonucleotide
ccacuucaauacaaagggugucguucu

SEQ ID NO: 9990 - RNA, 27 nt, Artificial Sequence
  Synthetic Oligonucleotide
uuuccaagaucugacagugcacaauau

SEQ ID NO: 9991 - RNA, 27 nt, Artificial Sequence
  Synthetic Oligonucleotide
cacuucaauacaaagggugucguucuu

SEQ ID NO: 9992 - RNA, 27 nt, Artificial Sequence
  Synthetic Oligonucleotide
acuuugagaagguagcacuggagagaa

SEQ ID NO: 9993 - RNA, 27 nt, Artificial Sequence
  Synthetic Oligonucleotide
cugccgccacaacucaggaugaaaaau

SEQ ID NO: 9994 - RNA, 27 nt, Artificial Sequence
  Synthetic Oligonucleotide
guugcugaaacagaucugucgacuucu

SEQ ID NO: 9995 - RNA, 27 nt, Artificial Sequence
  Synthetic Oligonucleotide
ggaaccuuuuagaaagaaauggacuuu

SEQ ID NO: 9996 - RNA, 27 nt, Artificial Sequence
  Synthetic Oligonucleotide
caugucuuuaaaacagugguucuuaaa

SEQ ID NO: 9997 - RNA, 27 nt, Artificial Sequence
  Synthetic Oligonucleotide
auugauguucugccagaaauuguggag

SEQ ID NO: 9998 - RNA, 27 nt, Artificial Sequence
  Synthetic Oligonucleotide
ggggugccagccacuauugauguucug

SEQ ID NO: 9999 - RNA, 27 nt, Artificial Sequence
  Synthetic Oligonucleotide
gagacgacaguggacuugcugcauaug

SEQ ID NO: 10000 - RNA, 27 nt, Artificial Sequence
  Synthetic Oligonucleotide
uguugcaaagggcauuuugagagguga

SEQ ID NO: 10001 - RNA, 27 nt, Artificial Sequence
  Synthetic Oligonucleotide
aaggaccgagaagucaccaagaagcua

SEQ ID NO: 10002 - RNA, 27 nt, Artificial Sequence
  Synthetic Oligonucleotide
cuccggaauguugcugaaacagaucug

SEQ ID NO: 10003 - RNA, 27 nt, Artificial Sequence
  Synthetic Oligonucleotide
caggucuggggcaaaugaugaagaaac

SEQ ID NO: 10004 - RNA, 27 nt, Artificial Sequence
  Synthetic Oligonucleotide
gugccagccacuauugauguucugcca

SEQ ID NO: 10005 - RNA, 27 nt, Artificial Sequence
  Synthetic Oligonucleotide
gugcggaaaggcacugauguucugaaa

SEQ ID NO: 10006 - RNA, 27 nt, Artificial Sequence
  Synthetic Oligonucleotide
cuugcugcauauguggcuaaagcaaua

SEQ ID NO: 10007 - RNA, 27 nt, Artificial Sequence
  Synthetic Oligonucleotide
cugggaagauaucaaauggcugagaag

SEQ ID NO: 10008 - RNA, 27 nt, Artificial Sequence
  Synthetic Oligonucleotide
gguguccuaggaaccuuuuagaaagaa

SEQ ID NO: 10009 - RNA, 27 nt, Artificial Sequence
  Synthetic Oligonucleotide
cucgagauacuaaaggaagaauuccgg

SEQ ID NO: 10010 - RNA, 27 nt, Artificial Sequence
  Synthetic Oligonucleotide
ugggcuacaaggccauauuugugacag

SEQ ID NO: 10011 - RNA, 27 nt, Artificial Sequence
  Synthetic Oligonucleotide
uucacaacuuugagaagguagcacugg

SEQ ID NO: 10012 - RNA, 27 nt, Artificial Sequence
  Synthetic Oligonucleotide
gcacuucguuggcugcaacuguauauc

SEQ ID NO: 10013 - RNA, 27 nt, Artificial Sequence
  Synthetic Oligonucleotide
ugauguucugccagaaauuguggaggc

SEQ ID NO: 10014 - RNA, 27 nt, Artificial Sequence
  Synthetic Oligonucleotide
uguagauuuccaaucacaucuuuagug

SEQ ID NO: 10015 - RNA, 27 nt, Artificial Sequence
  Synthetic Oligonucleotide
uggacuugcugcauauguggcuaaagc

SEQ ID NO: 10016 - RNA, 27 nt, Artificial Sequence
  Synthetic Oligonucleotide
agcauuuuccagauggaagcuguaucc

SEQ ID NO: 10017 - RNA, 27 nt, Artificial Sequence
  Synthetic Oligonucleotide
agacauuggugaggaaaaauccuuugg

SEQ ID NO: 10018 - RNA, 27 nt, Artificial Sequence
  Synthetic Oligonucleotide
ggugccagccacuauugauguucugcc

SEQ ID NO: 10019 - RNA, 27 nt, Artificial Sequence
  Synthetic Oligonucleotide
uacaaggaccgagaagucaccaagaag

SEQ ID NO: 10020 - RNA, 27 nt, Artificial Sequence
  Synthetic Oligonucleotide
caaggccauauuugugacaguggacac

SEQ ID NO: 10021 - RNA, 27 nt, Artificial Sequence
  Synthetic Oligonucleotide
gguggcgguaauuggugauacuucuuu

SEQ ID NO: 10022 - RNA, 27 nt, Artificial Sequence
  Synthetic Oligonucleotide
uguauccaaggaugcuccggaauguug

SEQ ID NO: 10023 - RNA, 27 nt, Artificial Sequence
  Synthetic Oligonucleotide
cagauggaagcuguauccaaggaugcu

SEQ ID NO: 10024 - RNA, 27 nt, Artificial Sequence
  Synthetic Oligonucleotide
ucaauggguguccuaggaaccuuuuag

SEQ ID NO: 10025 - RNA, 27 nt, Artificial Sequence
  Synthetic Oligonucleotide
acaacuuugagaagguagcacuggaga

SEQ ID NO: 10026 - RNA, 27 nt, Artificial Sequence
  Synthetic Oligonucleotide
uuacaugucuuuaaaacagugguucuu

SEQ ID NO: 10027 - RNA, 27 nt, Artificial Sequence
  Synthetic Oligonucleotide
aauggguggcgguaauuggugauacuu

SEQ ID NO: 10028 - RNA, 27 nt, Artificial Sequence
  Synthetic Oligonucleotide
uuuucaauggguguccuaggaaccuuu

SEQ ID NO: 10029 - RNA, 27 nt, Artificial Sequence
  Synthetic Oligonucleotide
cuugacaaagagacacugugcagaggg

SEQ ID NO: 10030 - RNA, 27 nt, Artificial Sequence
  Synthetic Oligonucleotide
agaaagaaauggacuuucauccuggaa

SEQ ID NO: 10031 - RNA, 27 nt, Artificial Sequence
  Synthetic Oligonucleotide
gcuguauccuuuaguaaaauuggaggu

SEQ ID NO: 10032 - RNA, 27 nt, Artificial Sequence
  Synthetic Oligonucleotide
cuaucagcugggaagauaucaaauggc

SEQ ID NO: 10033 - RNA, 27 nt, Artificial Sequence
  Synthetic Oligonucleotide
gggugccagccacuauugauguucugc

SEQ ID NO: 10034 - RNA, 27 nt, Artificial Sequence
  Synthetic Oligonucleotide
uacaggucuggggcaaaugaugaagaa

SEQ ID NO: 10035 - RNA, 27 nt, Artificial Sequence
  Synthetic Oligonucleotide
gugggugccagaaugugaaagucaucg

SEQ ID NO: 10036 - RNA, 27 nt, Artificial Sequence
  Synthetic Oligonucleotide
gauggaagcuguauccaaggaugcucc

SEQ ID NO: 10037 - RNA, 27 nt, Artificial Sequence
  Synthetic Oligonucleotide
ucugagugggugccagaaugugaaagu

SEQ ID NO: 10038 - RNA, 27 nt, Artificial Sequence
  Synthetic Oligonucleotide
auuuuccagauggaagcuguauccaag

SEQ ID NO: 10039 - RNA, 27 nt, Artificial Sequence
  Synthetic Oligonucleotide
auaucuacaaggaccgagaagucacca

SEQ ID NO: 10040 - RNA, 27 nt, Artificial Sequence
  Synthetic Oligonucleotide
ugaggaaaauuuuggagacgacagugg

SEQ ID NO: 10041 - RNA, 27 nt, Artificial Sequence
  Synthetic Oligonucleotide
gagggugaccacagucuguaauucccc

SEQ ID NO: 10042 - RNA, 27 nt, Artificial Sequence
  Synthetic Oligonucleotide
uugacaaagagacacugugcagagggu

SEQ ID NO: 10043 - RNA, 27 nt, Artificial Sequence
  Synthetic Oligonucleotide
aaagguguucaagauguccucgagaua

SEQ ID NO: 10044 - RNA, 27 nt, Artificial Sequence
  Synthetic Oligonucleotide
uagcacuggagagaauuggaaugggug

SEQ ID NO: 10045 - RNA, 27 nt, Artificial Sequence
  Synthetic Oligonucleotide
uuuacaugucuuuaaaacagugguucu

SEQ ID NO: 10046 - RNA, 27 nt, Artificial Sequence
  Synthetic Oligonucleotide
ccgagaagucaccaagaagcuagugcg

SEQ ID NO: 10047 - RNA, 27 nt, Artificial Sequence
  Synthetic Oligonucleotide
agucuauauaugacuauuacaggucug

SEQ ID NO: 10048 - RNA, 27 nt, Artificial Sequence
  Synthetic Oligonucleotide
gucuauauaugacuauuacaggucugg

SEQ ID NO: 10049 - RNA, 27 nt, Artificial Sequence
  Synthetic Oligonucleotide
gcaaagggcauuuugagaggugaugau

SEQ ID NO: 10050 - RNA, 27 nt, Artificial Sequence
  Synthetic Oligonucleotide
gggaagauaucaaauggcugagaagac

SEQ ID NO: 10051 - RNA, 27 nt, Artificial Sequence
  Synthetic Oligonucleotide
acagauucaaacugccgccacaacuca

SEQ ID NO: 10052 - RNA, 27 nt, Artificial Sequence
  Synthetic Oligonucleotide
aggaugcuccggaauguugcugaaaca

SEQ ID NO: 10053 - RNA, 27 nt, Artificial Sequence
  Synthetic Oligonucleotide
ccugaggaaaauuuuggagacgacagu

SEQ ID NO: 10054 - RNA, 27 nt, Artificial Sequence
  Synthetic Oligonucleotide
cuacaaggaccgagaagucaccaagaa

SEQ ID NO: 10055 - RNA, 27 nt, Artificial Sequence
  Synthetic Oligonucleotide
gcaaaugaugaagaaacuuuggcugau

SEQ ID NO: 10056 - RNA, 27 nt, Artificial Sequence
  Synthetic Oligonucleotide
aaaggcacugauguucugaaagcucug

SEQ ID NO: 10057 - RNA, 27 nt, Artificial Sequence
  Synthetic Oligonucleotide
ggcaaaugaugaagaaacuuuggcuga

SEQ ID NO: 10058 - RNA, 27 nt, Artificial Sequence
  Synthetic Oligonucleotide
auggguggcgguaauuggugauacuuc

SEQ ID NO: 10059 - RNA, 27 nt, Artificial Sequence
  Synthetic Oligonucleotide
ucuggggcaaaugaugaagaaacuuug

SEQ ID NO: 10060 - RNA, 27 nt, Artificial Sequence
  Synthetic Oligonucleotide
gaauggguggcgguaauuggugauacu

SEQ ID NO: 10061 - RNA, 27 nt, Artificial Sequence
  Synthetic Oligonucleotide
cugucgacuucuguuuuaggacagagg

SEQ ID NO: 10062 - RNA, 27 nt, Artificial Sequence
  Synthetic Oligonucleotide
gcugcaacuguauaucuacaaggaccg

SEQ ID NO: 10063 - RNA, 27 nt, Artificial Sequence
  Synthetic Oligonucleotide
gcauauguggcuaaagcaauagaccca

SEQ ID NO: 10064 - RNA, 27 nt, Artificial Sequence
  Synthetic Oligonucleotide
aacugccgccacaacucaggaugaaaa

SEQ ID NO: 10065 - RNA, 27 nt, Artificial Sequence
  Synthetic Oligonucleotide
ucuaucagcugggaagauaucaaaugg

SEQ ID NO: 10066 - RNA, 27 nt, Artificial Sequence
  Synthetic Oligonucleotide
uaaaauuggagguagcaaacacuaagg

SEQ ID NO: 10067 - RNA, 27 nt, Artificial Sequence
  Synthetic Oligonucleotide
gacauuggugaggaaaaauccuuuggc

SEQ ID NO: 10068 - RNA, 27 nt, Artificial Sequence
  Synthetic Oligonucleotide
acaaagagacacugugcagagggugac

SEQ ID NO: 10069 - RNA, 27 nt, Artificial Sequence
  Synthetic Oligonucleotide
ugaccacagucuguaauuccccacuuc

SEQ ID NO: 10070 - RNA, 27 nt, Artificial Sequence
  Synthetic Oligonucleotide
gggagaaagguguucaagauguccucg

SEQ ID NO: 10071 - RNA, 27 nt, Artificial Sequence
  Synthetic Oligonucleotide
cuuugagaagguagcacuggagagaau

SEQ ID NO: 10072 - RNA, 27 nt, Artificial Sequence
  Synthetic Oligonucleotide
aaagggcauuuugagaggugaugaugc

SEQ ID NO: 10073 - RNA, 27 nt, Artificial Sequence
  Synthetic Oligonucleotide
uuacaggucuggggcaaaugaugaaga

SEQ ID NO: 10074 - RNA, 27 nt, Artificial Sequence
  Synthetic Oligonucleotide
cauuuucuccugaggaaaauuuuggag

SEQ ID NO: 10075 - RNA, 27 nt, Artificial Sequence
  Synthetic Oligonucleotide
guauccuuuaguaaaauuggagguagc

SEQ ID NO: 10076 - RNA, 27 nt, Artificial Sequence
  Synthetic Oligonucleotide
aucuaucagcugggaagauaucaaaug

SEQ ID NO: 10077 - RNA, 27 nt, Artificial Sequence
  Synthetic Oligonucleotide
cugggccaccuccucaauugaagaagu

SEQ ID NO: 10078 - RNA, 27 nt, Artificial Sequence
  Synthetic Oligonucleotide
ucuacaaggaccgagaagucaccaaga

SEQ ID NO: 10079 - RNA, 27 nt, Artificial Sequence
  Synthetic Oligonucleotide
ggaauggguggcgguaauuggugauac

SEQ ID NO: 10080 - RNA, 27 nt, Artificial Sequence
  Synthetic Oligonucleotide
gggcuacaaggccauauuugugacagu

SEQ ID NO: 10081 - RNA, 27 nt, Artificial Sequence
  Synthetic Oligonucleotide
uuuucuccugaggaaaauuuuggagac

SEQ ID NO: 10082 - RNA, 27 nt, Artificial Sequence
  Synthetic Oligonucleotide
aggaccgagaagucaccaagaagcuag

SEQ ID NO: 10083 - RNA, 27 nt, Artificial Sequence
  Synthetic Oligonucleotide
ggguguccuaggaaccuuuuagaaaga

SEQ ID NO: 10084 - RNA, 27 nt, Artificial Sequence
  Synthetic Oligonucleotide
accgagaagucaccaagaagcuagugc

SEQ ID NO: 10085 - RNA, 27 nt, Artificial Sequence
  Synthetic Oligonucleotide
ccucgagauacuaaaggaagaauuccg

SEQ ID NO: 10086 - RNA, 27 nt, Artificial Sequence
  Synthetic Oligonucleotide
ggagacgacaguggacuugcugcauau

SEQ ID NO: 10087 - RNA, 27 nt, Artificial Sequence
  Synthetic Oligonucleotide
uagacccaucuaucagcugggaagaua

SEQ ID NO: 10088 - RNA, 27 nt, Artificial Sequence
  Synthetic Oligonucleotide
cucugagugggugccagaaugugaaag

SEQ ID NO: 10089 - RNA, 27 nt, Artificial Sequence
  Synthetic Oligonucleotide
gacaaagagacacugugcagaggguga

SEQ ID NO: 10090 - RNA, 27 nt, Artificial Sequence
  Synthetic Oligonucleotide
uugcugcauauguggcuaaagcaauag

SEQ ID NO: 10091 - RNA, 27 nt, Artificial Sequence
  Synthetic Oligonucleotide
acuucuuagagagaaauaaagcauuuu

SEQ ID NO: 10092 - RNA, 27 nt, Artificial Sequence
  Synthetic Oligonucleotide
uucaauggguguccuaggaaccuuuua

SEQ ID NO: 10093 - RNA, 27 nt, Artificial Sequence
  Synthetic Oligonucleotide
acccaucuaucagcugggaagauauca

SEQ ID NO: 10094 - RNA, 27 nt, Artificial Sequence
  Synthetic Oligonucleotide
ucuauauaugacuauuacaggucuggg

SEQ ID NO: 10095 - RNA, 27 nt, Artificial Sequence
  Synthetic Oligonucleotide
acaggucuggggcaaaugaugaagaaa

SEQ ID NO: 10096 - RNA, 27 nt, Artificial Sequence
  Synthetic Oligonucleotide
caauagacccaucuaucagcugggaag

SEQ ID NO: 10097 - RNA, 27 nt, Artificial Sequence
  Synthetic Oligonucleotide
auugccaauuguugcaaagggcauuuu

SEQ ID NO: 10098 - RNA, 27 nt, Artificial Sequence
  Synthetic Oligonucleotide
agauguccucgagauacuaaaggaaga

SEQ ID NO: 10099 - RNA, 27 nt, Artificial Sequence
  Synthetic Oligonucleotide
uuguugcaaagggcauuuugagaggug

SEQ ID NO: 10100 - RNA, 27 nt, Artificial Sequence
  Synthetic Oligonucleotide
gugugcggaaaggcacugauguucuga

SEQ ID NO: 10101 - RNA, 27 nt, Artificial Sequence
  Synthetic Oligonucleotide
gcuccggaauguugcugaaacagaucu

SEQ ID NO: 10102 - RNA, 27 nt, Artificial Sequence
  Synthetic Oligonucleotide
agguagcacuggagagaauuggaaugg

SEQ ID NO: 10103 - RNA, 27 nt, Artificial Sequence
  Synthetic Oligonucleotide
cgacaguggacuugcugcauauguggc

SEQ ID NO: 10104 - RNA, 27 nt, Artificial Sequence
  Synthetic Oligonucleotide
acaguggacuugcugcauauguggcua

SEQ ID NO: 10105 - RNA, 27 nt, Artificial Sequence
  Synthetic Oligonucleotide
ugaggcacuucguuggcugcaacugua

SEQ ID NO: 10106 - RNA, 27 nt, Artificial Sequence
  Synthetic Oligonucleotide
auuuccaaucacaucuuuagugucuga

SEQ ID NO: 10107 - RNA, 27 nt, Artificial Sequence
  Synthetic Oligonucleotide
aauuuuggagacgacaguggacuugcu

SEQ ID NO: 10108 - RNA, 27 nt, Artificial Sequence
  Synthetic Oligonucleotide
uauccuuuaguaaaauuggagguagca

SEQ ID NO: 10109 - RNA, 27 nt, Artificial Sequence
  Synthetic Oligonucleotide
cuugaaugggaucuuggugucgaauca

SEQ ID NO: 10110 - RNA, 27 nt, Artificial Sequence
  Synthetic Oligonucleotide
gcacugauguucugaaagcucuggcuc

SEQ ID NO: 10111 - RNA, 27 nt, Artificial Sequence
  Synthetic Oligonucleotide
agcuugccacugugagagccugucagu

SEQ ID NO: 10112 - RNA, 27 nt, Artificial Sequence
  Synthetic Oligonucleotide
ggaaaauuuuggagacgacaguggacu

SEQ ID NO: 10113 - RNA, 27 nt, Artificial Sequence
  Synthetic Oligonucleotide
gggugaccacagucuguaauuccccac

SEQ ID NO: 10114 - RNA, 27 nt, Artificial Sequence
  Synthetic Oligonucleotide
uaggacagagggucagcaugccaauau

SEQ ID NO: 10115 - RNA, 27 nt, Artificial Sequence
  Synthetic Oligonucleotide
ggguggcgguaauuggugauacuucuu

SEQ ID NO: 10116 - RNA, 27 nt, Artificial Sequence
  Synthetic Oligonucleotide
gggcauuuugagaggugaugaugccag

SEQ ID NO: 10117 - RNA, 27 nt, Artificial Sequence
  Synthetic Oligonucleotide
auggaagcuguauccaaggaugcuccg

SEQ ID NO: 10118 - RNA, 27 nt, Artificial Sequence
  Synthetic Oligonucleotide
gguagcacuggagagaauuggaauggg

SEQ ID NO: 10119 - RNA, 27 nt, Artificial Sequence
  Synthetic Oligonucleotide
ggaccgagaagucaccaagaagcuagu

SEQ ID NO: 10120 - RNA, 27 nt, Artificial Sequence
  Synthetic Oligonucleotide
gacccaucuaucagcugggaagauauc

SEQ ID NO: 10121 - RNA, 27 nt, Artificial Sequence
  Synthetic Oligonucleotide
agggaggcuguuaaacauggcuugaau

SEQ ID NO: 10122 - RNA, 27 nt, Artificial Sequence
  Synthetic Oligonucleotide
caaggaccgagaagucaccaagaagcu

SEQ ID NO: 10123 - RNA, 27 nt, Artificial Sequence
  Synthetic Oligonucleotide
gcugggaagauaucaaauggcugagaa

SEQ ID NO: 10124 - RNA, 27 nt, Artificial Sequence
  Synthetic Oligonucleotide
uaucagcugggaagauaucaaauggcu

SEQ ID NO: 10125 - RNA, 27 nt, Artificial Sequence
  Synthetic Oligonucleotide
guuaaacauggcuugaaugggaucuug

SEQ ID NO: 10126 - RNA, 27 nt, Artificial Sequence
  Synthetic Oligonucleotide
aggaaaauuuuggagacgacaguggac

SEQ ID NO: 10127 - RNA, 27 nt, Artificial Sequence
  Synthetic Oligonucleotide
ggggagaaagguguucaagauguccuc

SEQ ID NO: 10128 - RNA, 27 nt, Artificial Sequence
  Synthetic Oligonucleotide
guugcaaagggcauuuugagaggugau

SEQ ID NO: 10129 - RNA, 27 nt, Artificial Sequence
  Synthetic Oligonucleotide
aauuguugcaaagggcauuuugagagg

SEQ ID NO: 10130 - RNA, 27 nt, Artificial Sequence
  Synthetic Oligonucleotide
cuuuuccaacaaaauagcaaucccuuu

SEQ ID NO: 10131 - RNA, 27 nt, Artificial Sequence
  Synthetic Oligonucleotide
aauuccccacuucaauacaaagggugu

SEQ ID NO: 10132 - RNA, 27 nt, Artificial Sequence
  Synthetic Oligonucleotide
ugacuauuacaggucuggggcaaauga

SEQ ID NO: 10133 - RNA, 27 nt, Artificial Sequence
  Synthetic Oligonucleotide
agaaauuguggaggcuguggaagggaa

SEQ ID NO: 10134 - RNA, 27 nt, Artificial Sequence
  Synthetic Oligonucleotide
ugugcagagggugaccacagucuguaa

SEQ ID NO: 10135 - RNA, 27 nt, Artificial Sequence
  Synthetic Oligonucleotide
aucauugccaauuguugcaaagggcau

SEQ ID NO: 10136 - RNA, 27 nt, Artificial Sequence
  Synthetic Oligonucleotide
guauccaaggaugcuccggaauguugc

SEQ ID NO: 10137 - RNA, 27 nt, Artificial Sequence
  Synthetic Oligonucleotide
gagauacuaaaggaagaauuccgguug

SEQ ID NO: 10138 - RNA, 27 nt, Artificial Sequence
  Synthetic Oligonucleotide
aagagacacugugcagagggugaccac

SEQ ID NO: 10139 - RNA, 27 nt, Artificial Sequence
  Synthetic Oligonucleotide
gaaaauuuuggagacgacaguggacuu

SEQ ID NO: 10140 - RNA, 27 nt, Artificial Sequence
  Synthetic Oligonucleotide
gaucugucgacuucuguuuuaggacag

SEQ ID NO: 10141 - RNA, 27 nt, Artificial Sequence
  Synthetic Oligonucleotide
ggugaccacagucuguaauuccccacu

SEQ ID NO: 10142 - RNA, 27 nt, Artificial Sequence
  Synthetic Oligonucleotide
cacugugcagagggugaccacagucug

SEQ ID NO: 10143 - RNA, 27 nt, Artificial Sequence
  Synthetic Oligonucleotide
uuucaauggguguccuaggaaccuuuu

SEQ ID NO: 10144 - RNA, 27 nt, Artificial Sequence
  Synthetic Oligonucleotide
cuuuucaauggguguccuaggaaccuu

SEQ ID NO: 10145 - RNA, 27 nt, Artificial Sequence
  Synthetic Oligonucleotide
gggugugcggaaaggcacugauguucu

SEQ ID NO: 10146 - RNA, 27 nt, Artificial Sequence
  Synthetic Oligonucleotide
uauguggcuaaagcaauagacccaucu

SEQ ID NO: 10147 - RNA, 27 nt, Artificial Sequence
  Synthetic Oligonucleotide
ucgacuucuguuuuaggacagaggguc

SEQ ID NO: 10148 - RNA, 27 nt, Artificial Sequence
  Synthetic Oligonucleotide
agauuuccaaucacaucuuuagugucu

SEQ ID NO: 10149 - RNA, 27 nt, Artificial Sequence
  Synthetic Oligonucleotide
gauguccucgagauacuaaaggaagaa

SEQ ID NO: 10150 - RNA, 27 nt, Artificial Sequence
  Synthetic Oligonucleotide
uugcaaagggcauuuugagaggugaug

SEQ ID NO: 10151 - RNA, 27 nt, Artificial Sequence
  Synthetic Oligonucleotide
agauacuaaaggaagaauuccgguugg

SEQ ID NO: 10152 - RNA, 27 nt, Artificial Sequence
  Synthetic Oligonucleotide
ggcuugaaugggaucuuggugucgaau

SEQ ID NO: 10153 - RNA, 27 nt, Artificial Sequence
  Synthetic Oligonucleotide
ucuguuuuaggacagagggucagcaug

SEQ ID NO: 10154 - RNA, 27 nt, Artificial Sequence
  Synthetic Oligonucleotide
cugggaacgggcaugauguugaguucc

SEQ ID NO: 10155 - RNA, 27 nt, Artificial Sequence
  Synthetic Oligonucleotide
uaucuacaaggaccgagaagucaccaa

SEQ ID NO: 10156 - RNA, 27 nt, Artificial Sequence
  Synthetic Oligonucleotide
ucuccugaggaaaauuuuggagacgac

SEQ ID NO: 10157 - RNA, 27 nt, Artificial Sequence
  Synthetic Oligonucleotide
aggcuguuaaacauggcuugaauggga

SEQ ID NO: 10158 - RNA, 27 nt, Artificial Sequence
  Synthetic Oligonucleotide
cgauggggugccagccacuauugaugu

SEQ ID NO: 10159 - RNA, 27 nt, Artificial Sequence
  Synthetic Oligonucleotide
agaugggcuacaaggccauauuuguga

SEQ ID NO: 10160 - RNA, 27 nt, Artificial Sequence
  Synthetic Oligonucleotide
ggcuguuaaacauggcuugaaugggau

SEQ ID NO: 10161 - RNA, 27 nt, Artificial Sequence
  Synthetic Oligonucleotide
agggcauuuugagaggugaugaugcca

SEQ ID NO: 10162 - RNA, 27 nt, Artificial Sequence
  Synthetic Oligonucleotide
aaaauuuuggagacgacaguggacuug

SEQ ID NO: 10163 - RNA, 27 nt, Artificial Sequence
  Synthetic Oligonucleotide
agugggugccagaaugugaaagucauc

SEQ ID NO: 10164 - RNA, 27 nt, Artificial Sequence
  Synthetic Oligonucleotide
gcaaccgucuggaugaugugcguaaca

SEQ ID NO: 10165 - RNA, 27 nt, Artificial Sequence
  Synthetic Oligonucleotide
aagcaauagacccaucuaucagcuggg

SEQ ID NO: 10166 - RNA, 27 nt, Artificial Sequence
  Synthetic Oligonucleotide
aguggacuugcugcauauguggcuaaa

SEQ ID NO: 10167 - RNA, 27 nt, Artificial Sequence
  Synthetic Oligonucleotide
ucauugccaauuguugcaaagggcauu

SEQ ID NO: 10168 - RNA, 27 nt, Artificial Sequence
  Synthetic Oligonucleotide
gacuauuacaggucuggggcaaaugau

SEQ ID NO: 10169 - RNA, 27 nt, Artificial Sequence
  Synthetic Oligonucleotide
auccaaggaugcuccggaauguugcug

SEQ ID NO: 10170 - RNA, 27 nt, Artificial Sequence
  Synthetic Oligonucleotide
ugccagaaauuguggaggcuguggaag

SEQ ID NO: 10171 - RNA, 27 nt, Artificial Sequence
  Synthetic Oligonucleotide
gcuacaaggccauauuugugacagugg

SEQ ID NO: 10172 - RNA, 27 nt, Artificial Sequence
  Synthetic Oligonucleotide
uggaauggguggcgguaauuggugaua

SEQ ID NO: 10173 - RNA, 27 nt, Artificial Sequence
  Synthetic Oligonucleotide
cucgauggggugccagccacuauugau

SEQ ID NO: 10174 - RNA, 27 nt, Artificial Sequence
  Synthetic Oligonucleotide
uuaaacauggcuugaaugggaucuugg

SEQ ID NO: 10175 - RNA, 27 nt, Artificial Sequence
  Synthetic Oligonucleotide
uuccccacuucaauacaaagggugucg

SEQ ID NO: 10176 - RNA, 27 nt, Artificial Sequence
  Synthetic Oligonucleotide
ucuguuuacaugucuuuaaaacagugg

SEQ ID NO: 10177 - RNA, 27 nt, Artificial Sequence
  Synthetic Oligonucleotide
cacugauguucugaaagcucuggcucu

SEQ ID NO: 10178 - RNA, 27 nt, Artificial Sequence
  Synthetic Oligonucleotide
gcucugagugggugccagaaugugaaa

SEQ ID NO: 10179 - RNA, 27 nt, Artificial Sequence
  Synthetic Oligonucleotide
acuugacaaagagacacugugcagagg

SEQ ID NO: 10180 - RNA, 27 nt, Artificial Sequence
  Synthetic Oligonucleotide
ugucgacuucuguuuuaggacagaggg

SEQ ID NO: 10181 - RNA, 27 nt, Artificial Sequence
  Synthetic Oligonucleotide
uuggagacgacaguggacuugcugcau

SEQ ID NO: 10182 - RNA, 27 nt, Artificial Sequence
  Synthetic Oligonucleotide
aagggcauuuugagaggugaugaugcc

SEQ ID NO: 10183 - RNA, 27 nt, Artificial Sequence
  Synthetic Oligonucleotide
cacaacuuugagaagguagcacuggag

SEQ ID NO: 10184 - RNA, 27 nt, Artificial Sequence
  Synthetic Oligonucleotide
augggcuacaaggccauauuugugaca

SEQ ID NO: 10185 - RNA, 27 nt, Artificial Sequence
  Synthetic Oligonucleotide
ugggccaccuccucaauugaagaagug

SEQ ID NO: 10186 - RNA, 27 nt, Artificial Sequence
  Synthetic Oligonucleotide
ccguuuccaagaucugacagugcacaa

SEQ ID NO: 10187 - RNA, 27 nt, Artificial Sequence
  Synthetic Oligonucleotide
ggggcaaaugaugaagaaacuuuggcu

SEQ ID NO: 10188 - RNA, 27 nt, Artificial Sequence
  Synthetic Oligonucleotide
gaaugggaucuuggugucgaaucaugg

SEQ ID NO: 10189 - RNA, 27 nt, Artificial Sequence
  Synthetic Oligonucleotide
ugcguaacagauucaaacugccgccac

SEQ ID NO: 10190 - RNA, 27 nt, Artificial Sequence
  Synthetic Oligonucleotide
gaugggcuacaaggccauauuugugac

SEQ ID NO: 10191 - RNA, 27 nt, Artificial Sequence
  Synthetic Oligonucleotide
ugggaacgggcaugauguugaguuccu

SEQ ID NO: 10192 - RNA, 27 nt, Artificial Sequence
  Synthetic Oligonucleotide
uucuguuuuaggacagagggucagcau

SEQ ID NO: 10193 - RNA, 27 nt, Artificial Sequence
  Synthetic Oligonucleotide
aaacugccgccacaacucaggaugaaa

SEQ ID NO: 10194 - RNA, 27 nt, Artificial Sequence
  Synthetic Oligonucleotide
gagaagaugggcuacaaggccauauuu

SEQ ID NO: 10195 - RNA, 27 nt, Artificial Sequence
  Synthetic Oligonucleotide
uaacagauucaaacugccgccacaacu

SEQ ID NO: 10196 - RNA, 27 nt, Artificial Sequence
  Synthetic Oligonucleotide
uauccaaggaugcuccggaauguugcu

SEQ ID NO: 10197 - RNA, 27 nt, Artificial Sequence
  Synthetic Oligonucleotide
uuuccagauggaagcuguauccaagga

SEQ ID NO: 10198 - RNA, 27 nt, Artificial Sequence
  Synthetic Oligonucleotide
gaagcuguauccaaggaugcuccggaa

SEQ ID NO: 10199 - RNA, 27 nt, Artificial Sequence
  Synthetic Oligonucleotide
ucgauggggugccagccacuauugaug

SEQ ID NO: 10200 - RNA, 27 nt, Artificial Sequence
  Synthetic Oligonucleotide
uuuuggagacgacaguggacuugcugc

SEQ ID NO: 10201 - RNA, 27 nt, Artificial Sequence
  Synthetic Oligonucleotide
uguuaaacauggcuugaaugggaucuu

SEQ ID NO: 10202 - RNA, 27 nt, Artificial Sequence
  Synthetic Oligonucleotide
aggcacuucguuggcugcaacuguaua

SEQ ID NO: 10203 - RNA, 27 nt, Artificial Sequence
  Synthetic Oligonucleotide
auggcuugaaugggaucuuggugucga

SEQ ID NO: 10204 - RNA, 27 nt, Artificial Sequence
  Synthetic Oligonucleotide
ucagcugggaagauaucaaauggcuga

SEQ ID NO: 10205 - RNA, 27 nt, Artificial Sequence
  Synthetic Oligonucleotide
uuuuccagauggaagcuguauccaagg

SEQ ID NO: 10206 - RNA, 27 nt, Artificial Sequence
  Synthetic Oligonucleotide
agcaauagacccaucuaucagcuggga

SEQ ID NO: 10207 - RNA, 27 nt, Artificial Sequence
  Synthetic Oligonucleotide
cguuuccaagaucugacagugcacaau

SEQ ID NO: 10208 - RNA, 27 nt, Artificial Sequence
  Synthetic Oligonucleotide
caacuuugagaagguagcacuggagag

SEQ ID NO: 10209 - RNA, 27 nt, Artificial Sequence
  Synthetic Oligonucleotide
uugccacugugagagccugucaguccc

SEQ ID NO: 10210 - RNA, 27 nt, Artificial Sequence
  Synthetic Oligonucleotide
aacauggcuugaaugggaucuuggugu

SEQ ID NO: 10211 - RNA, 27 nt, Artificial Sequence
  Synthetic Oligonucleotide
agcugggaagauaucaaauggcugaga

SEQ ID NO: 10212 - RNA, 27 nt, Artificial Sequence
  Synthetic Oligonucleotide
gcuugaaugggaucuuggugucgaauc

SEQ ID NO: 10213 - RNA, 27 nt, Artificial Sequence
  Synthetic Oligonucleotide
gcaauagacccaucuaucagcugggaa

SEQ ID NO: 10214 - RNA, 27 nt, Artificial Sequence
  Synthetic Oligonucleotide
uuuugacuuuucaauggguguccuagg

SEQ ID NO: 10215 - RNA, 27 nt, Artificial Sequence
  Synthetic Oligonucleotide
uacuaaaggaagaauuccgguuggcca

SEQ ID NO: 10216 - RNA, 27 nt, Artificial Sequence
  Synthetic Oligonucleotide
acugccgccacaacucaggaugaaaaa

SEQ ID NO: 10217 - RNA, 27 nt, Artificial Sequence
  Synthetic Oligonucleotide
gaugugcguaacagauucaaacugccg

SEQ ID NO: 10218 - RNA, 27 nt, Artificial Sequence
  Synthetic Oligonucleotide
gggcaaaugaugaagaaacuuuggcug

SEQ ID NO: 10219 - RNA, 27 nt, Artificial Sequence
  Synthetic Oligonucleotide
ggaacgggcaugauguugaguuccugg

SEQ ID NO: 10220 - RNA, 27 nt, Artificial Sequence
  Synthetic Oligonucleotide
uggcuugaaugggaucuuggugucgaa

SEQ ID NO: 10221 - RNA, 27 nt, Artificial Sequence
  Synthetic Oligonucleotide
acauuggugaggaaaaauccuuuggcc

SEQ ID NO: 10222 - RNA, 27 nt, Artificial Sequence
  Synthetic Oligonucleotide
gucgaaucauggggcucgacaacucga

SEQ ID NO: 10223 - RNA, 27 nt, Artificial Sequence
  Synthetic Oligonucleotide
gaagaugggcuacaaggccauauuugu

SEQ ID NO: 10224 - RNA, 27 nt, Artificial Sequence
  Synthetic Oligonucleotide
augugcguaacagauucaaacugccgc

SEQ ID NO: 10225 - RNA, 27 nt, Artificial Sequence
  Synthetic Oligonucleotide
aacuuugagaagguagcacuggagaga

SEQ ID NO: 10226 - RNA, 27 nt, Artificial Sequence
  Synthetic Oligonucleotide
cuauuacaggucuggggcaaaugauga

SEQ ID NO: 10227 - RNA, 27 nt, Artificial Sequence
  Synthetic Oligonucleotide
uuugacuuuucaauggguguccuagga

SEQ ID NO: 10228 - RNA, 27 nt, Artificial Sequence
  Synthetic Oligonucleotide
gacacugugcagagggugaccacaguc

SEQ ID NO: 10229 - RNA, 27 nt, Artificial Sequence
  Synthetic Oligonucleotide
cagaaauuguggaggcuguggaaggga

SEQ ID NO: 10230 - RNA, 27 nt, Artificial Sequence
  Synthetic Oligonucleotide
cauugccaauuguugcaaagggcauuu

SEQ ID NO: 10231 - RNA, 27 nt, Artificial Sequence
  Synthetic Oligonucleotide
ggcuguggaagggaagguggaagucuu

SEQ ID NO: 10232 - RNA, 27 nt, Artificial Sequence
  Synthetic Oligonucleotide
gagcuugccacugugagagccugucag

SEQ ID NO: 10233 - RNA, 27 nt, Artificial Sequence
  Synthetic Oligonucleotide
cuguuuuaggacagagggucagcaugc

SEQ ID NO: 10234 - RNA, 27 nt, Artificial Sequence
  Synthetic Oligonucleotide
uggaagggaagguggaagucuuccugg

SEQ ID NO: 10235 - RNA, 27 nt, Artificial Sequence
  Synthetic Oligonucleotide
uggggcaaaugaugaagaaacuuuggc

SEQ ID NO: 10236 - RNA, 27 nt, Artificial Sequence
  Synthetic Oligonucleotide
caaacugccgccacaacucaggaugaa

SEQ ID NO: 10237 - RNA, 27 nt, Artificial Sequence
  Synthetic Oligonucleotide
ggaagcuguauccaaggaugcuccgga

SEQ ID NO: 10238 - RNA, 27 nt, Artificial Sequence
  Synthetic Oligonucleotide
uuuuaggacagagggucagcaugccaa

SEQ ID NO: 10239 - RNA, 27 nt, Artificial Sequence
  Synthetic Oligonucleotide
guggacuugcugcauauguggcuaaag

SEQ ID NO: 10240 - RNA, 27 nt, Artificial Sequence
  Synthetic Oligonucleotide
ggcucugagugggugccagaaugugaa

SEQ ID NO: 10241 - RNA, 27 nt, Artificial Sequence
  Synthetic Oligonucleotide
cuauauaugacuauuacaggucugggg

SEQ ID NO: 10242 - RNA, 27 nt, Artificial Sequence
  Synthetic Oligonucleotide
cguaacagauucaaacugccgccacaa

SEQ ID NO: 10243 - RNA, 27 nt, Artificial Sequence
  Synthetic Oligonucleotide
gauuuccaaucacaucuuuagugucug

SEQ ID NO: 10244 - RNA, 27 nt, Artificial Sequence
  Synthetic Oligonucleotide
caaagagacacugugcagagggugacc

SEQ ID NO: 10245 - RNA, 27 nt, Artificial Sequence
  Synthetic Oligonucleotide
cuguggaagggaagguggaagucuucc

SEQ ID NO: 10246 - RNA, 27 nt, Artificial Sequence
  Synthetic Oligonucleotide
gaccgagaagucaccaagaagcuagug

SEQ ID NO: 10247 - RNA, 27 nt, Artificial Sequence
  Synthetic Oligonucleotide
ugggcaaccgucuggaugaugugcgua

SEQ ID NO: 10248 - RNA, 27 nt, Artificial Sequence
  Synthetic Oligonucleotide
uggcaggcuaaagugcuguauccuuua

SEQ ID NO: 10249 - RNA, 27 nt, Artificial Sequence
  Synthetic Oligonucleotide
gggaggcuguuaaacauggcuugaaug

SEQ ID NO: 10250 - RNA, 27 nt, Artificial Sequence
  Synthetic Oligonucleotide
agagaauuggaauggguggcgguaauu

SEQ ID NO: 10251 - RNA, 27 nt, Artificial Sequence
  Synthetic Oligonucleotide
gacuuuucaauggguguccuaggaacc

SEQ ID NO: 10252 - RNA, 27 nt, Artificial Sequence
  Synthetic Oligonucleotide
augaugccagggaggcuguuaaacaug

SEQ ID NO: 10253 - RNA, 27 nt, Artificial Sequence
  Synthetic Oligonucleotide
cagauucaaacugccgccacaacucag

SEQ ID NO: 10254 - RNA, 27 nt, Artificial Sequence
  Synthetic Oligonucleotide
uuaggacagagggucagcaugccaaua

SEQ ID NO: 10255 - RNA, 27 nt, Artificial Sequence
  Synthetic Oligonucleotide
gagacacugugcagagggugaccacag

SEQ ID NO: 10256 - RNA, 27 nt, Artificial Sequence
  Synthetic Oligonucleotide
uuggugucgaaucauggggcucgacaa

SEQ ID NO: 10257 - RNA, 27 nt, Artificial Sequence
  Synthetic Oligonucleotide
aauagacccaucuaucagcugggaaga

SEQ ID NO: 10258 - RNA, 27 nt, Artificial Sequence
  Synthetic Oligonucleotide
acauggcuugaaugggaucuugguguc

SEQ ID NO: 10259 - RNA, 27 nt, Artificial Sequence
  Synthetic Oligonucleotide
uucaaacugccgccacaacucaggaug

SEQ ID NO: 10260 - RNA, 27 nt, Artificial Sequence
  Synthetic Oligonucleotide
ugaugaugccagggaggcuguuaaaca

SEQ ID NO: 10261 - RNA, 27 nt, Artificial Sequence
  Synthetic Oligonucleotide
uccugggccaccuccucaauugaagaa

SEQ ID NO: 10262 - RNA, 27 nt, Artificial Sequence
  Synthetic Oligonucleotide
ugauguucugaaagcucuggcucuugg

SEQ ID NO: 10263 - RNA, 27 nt, Artificial Sequence
  Synthetic Oligonucleotide
acuauuacaggucuggggcaaaugaug

SEQ ID NO: 10264 - RNA, 27 nt, Artificial Sequence
  Synthetic Oligonucleotide
gauggggugccagccacuauugauguu

SEQ ID NO: 10265 - RNA, 27 nt, Artificial Sequence
  Synthetic Oligonucleotide
gucgacuucuguuuuaggacagagggu

SEQ ID NO: 10266 - RNA, 27 nt, Artificial Sequence
  Synthetic Oligonucleotide
agacacugugcagagggugaccacagu

SEQ ID NO: 10267 - RNA, 27 nt, Artificial Sequence
  Synthetic Oligonucleotide
uuuaggacagagggucagcaugccaau

SEQ ID NO: 10268 - RNA, 27 nt, Artificial Sequence
  Synthetic Oligonucleotide
guggaagggaagguggaagucuuccug

SEQ ID NO: 10269 - RNA, 27 nt, Artificial Sequence
  Synthetic Oligonucleotide
aaggcacugauguucugaaagcucugg

SEQ ID NO: 10270 - RNA, 27 nt, Artificial Sequence
  Synthetic Oligonucleotide
auuacaggucuggggcaaaugaugaag

SEQ ID NO: 10271 - RNA, 27 nt, Artificial Sequence
  Synthetic Oligonucleotide
gagaauuggaauggguggcgguaauug

SEQ ID NO: 10272 - RNA, 27 nt, Artificial Sequence
  Synthetic Oligonucleotide
uauaucuacaaggaccgagaagucacc

SEQ ID NO: 10273 - RNA, 27 nt, Artificial Sequence
  Synthetic Oligonucleotide
aacagauucaaacugccgccacaacuc

SEQ ID NO: 10274 - RNA, 27 nt, Artificial Sequence
  Synthetic Oligonucleotide
aggucuggggcaaaugaugaagaaacu

SEQ ID NO: 10275 - RNA, 27 nt, Artificial Sequence
  Synthetic Oligonucleotide
gggcaaccgucuggaugaugugcguaa

SEQ ID NO: 10276 - RNA, 27 nt, Artificial Sequence
  Synthetic Oligonucleotide
uauuacaggucuggggcaaaugaugaa

SEQ ID NO: 10277 - RNA, 27 nt, Artificial Sequence
  Synthetic Oligonucleotide
cuggggcaaaugaugaagaaacuuugg

SEQ ID NO: 10278 - RNA, 27 nt, Artificial Sequence
  Synthetic Oligonucleotide
agaagaugggcuacaaggccauauuug

SEQ ID NO: 10279 - RNA, 27 nt, Artificial Sequence
  Synthetic Oligonucleotide
uuuggagacgacaguggacuugcugca

SEQ ID NO: 10280 - RNA, 27 nt, Artificial Sequence
  Synthetic Oligonucleotide
cauuuugagaggugaugaugccaggga

SEQ ID NO: 10281 - RNA, 27 nt, Artificial Sequence
  Synthetic Oligonucleotide
cgagaagucaccaagaagcuagugcgg

SEQ ID NO: 10282 - RNA, 27 nt, Artificial Sequence
  Synthetic Oligonucleotide
gggaacgggcaugauguugaguuccug

SEQ ID NO: 10283 - RNA, 27 nt, Artificial Sequence
  Synthetic Oligonucleotide
gaauuggaauggguggcgguaauuggu

SEQ ID NO: 10284 - RNA, 27 nt, Artificial Sequence
  Synthetic Oligonucleotide
auguucugccagaaauuguggaggcug

SEQ ID NO: 10285 - RNA, 27 nt, Artificial Sequence
  Synthetic Oligonucleotide
aggcuguggaagggaagguggaagucu

SEQ ID NO: 10286 - RNA, 27 nt, Artificial Sequence
  Synthetic Oligonucleotide
gagaccaaucguuuggggcuuagcuuu

SEQ ID NO: 10287 - RNA, 27 nt, Artificial Sequence
  Synthetic Oligonucleotide
ucaaacugccgccacaacucaggauga

SEQ ID NO: 10288 - RNA, 27 nt, Artificial Sequence
  Synthetic Oligonucleotide
ggucuggggcaaaugaugaagaaacuu

SEQ ID NO: 10289 - RNA, 27 nt, Artificial Sequence
  Synthetic Oligonucleotide
cucaauugaagaaguggcggaagcugg

SEQ ID NO: 10290 - RNA, 27 nt, Artificial Sequence
  Synthetic Oligonucleotide
gcaggcuaaagugcuguauccuuuagu

SEQ ID NO: 10291 - RNA, 27 nt, Artificial Sequence
  Synthetic Oligonucleotide
cagcugggaagauaucaaauggcugag

SEQ ID NO: 10292 - RNA, 27 nt, Artificial Sequence
  Synthetic Oligonucleotide
aagcuguauccaaggaugcuccggaau

SEQ ID NO: 10293 - RNA, 27 nt, Artificial Sequence
  Synthetic Oligonucleotide
cgagcuugccacugugagagccuguca

SEQ ID NO: 10294 - RNA, 27 nt, Artificial Sequence
  Synthetic Oligonucleotide
cccugggaacgggcaugauguugaguu

SEQ ID NO: 10295 - RNA, 27 nt, Artificial Sequence
  Synthetic Oligonucleotide
uuggaauggguggcgguaauuggugau

SEQ ID NO: 10296 - RNA, 27 nt, Artificial Sequence
  Synthetic Oligonucleotide
aggugaugaugccagggaggcuguuaa

SEQ ID NO: 10297 - RNA, 27 nt, Artificial Sequence
  Synthetic Oligonucleotide
guguuuagacaacgucauccccuggca

SEQ ID NO: 10298 - RNA, 27 nt, Artificial Sequence
  Synthetic Oligonucleotide
auuuuggagacgacaguggacuugcug

SEQ ID NO: 10299 - RNA, 27 nt, Artificial Sequence
  Synthetic Oligonucleotide
ggcauuuugagaggugaugaugccagg

SEQ ID NO: 10300 - RNA, 27 nt, Artificial Sequence
  Synthetic Oligonucleotide
aagaugggcuacaaggccauauuugug

SEQ ID NO: 10301 - RNA, 27 nt, Artificial Sequence
  Synthetic Oligonucleotide
gauacuaaaggaagaauuccgguuggc

SEQ ID NO: 10302 - RNA, 27 nt, Artificial Sequence
  Synthetic Oligonucleotide
auuuugagaggugaugaugccagggag

SEQ ID NO: 10303 - RNA, 27 nt, Artificial Sequence
  Synthetic Oligonucleotide
aggcacugauguucugaaagcucuggc

SEQ ID NO: 10304 - RNA, 27 nt, Artificial Sequence
  Synthetic Oligonucleotide
cagggaggcuguuaaacauggcuugaa

SEQ ID NO: 10305 - RNA, 27 nt, Artificial Sequence
  Synthetic Oligonucleotide
cuucuguuuuaggacagagggucagca

SEQ ID NO: 10306 - RNA, 27 nt, Artificial Sequence
  Synthetic Oligonucleotide
guaacagauucaaacugccgccacaac

SEQ ID NO: 10307 - RNA, 27 nt, Artificial Sequence
  Synthetic Oligonucleotide
cugccagaaauuguggaggcuguggaa

SEQ ID NO: 10308 - RNA, 27 nt, Artificial Sequence
  Synthetic Oligonucleotide
ggcaaccgucuggaugaugugcguaac

SEQ ID NO: 10309 - RNA, 27 nt, Artificial Sequence
  Synthetic Oligonucleotide
agagaagaugggcuacaaggccauauu

SEQ ID NO: 10310 - RNA, 27 nt, Artificial Sequence
  Synthetic Oligonucleotide
auagacccaucuaucagcugggaagau

SEQ ID NO: 10311 - RNA, 27 nt, Artificial Sequence
  Synthetic Oligonucleotide
uggcucugagugggugccagaauguga

SEQ ID NO: 10312 - RNA, 27 nt, Artificial Sequence
  Synthetic Oligonucleotide
gccguuuccaagaucugacagugcaca

SEQ ID NO: 10313 - RNA, 27 nt, Artificial Sequence
  Synthetic Oligonucleotide
ggggugugcggaaaggcacugauguuc

SEQ ID NO: 10314 - RNA, 27 nt, Artificial Sequence
  Synthetic Oligonucleotide
ucaauugaagaaguggcggaagcuggu

SEQ ID NO: 10315 - RNA, 27 nt, Artificial Sequence
  Synthetic Oligonucleotide
ccugggccaccuccucaauugaagaag

SEQ ID NO: 10316 - RNA, 27 nt, Artificial Sequence
  Synthetic Oligonucleotide
accuccucaauugaagaaguggcggaa

SEQ ID NO: 10317 - RNA, 27 nt, Artificial Sequence
  Synthetic Oligonucleotide
cuguuaaacauggcuugaaugggaucu

SEQ ID NO: 10318 - RNA, 27 nt, Artificial Sequence
  Synthetic Oligonucleotide
uggccguuuccaagaucugacagugca

SEQ ID NO: 10319 - RNA, 27 nt, Artificial Sequence
  Synthetic Oligonucleotide
uccucaauugaagaaguggcggaagcu

SEQ ID NO: 10320 - RNA, 27 nt, Artificial Sequence
  Synthetic Oligonucleotide
uauauaugacuauuacaggucuggggc

SEQ ID NO: 10321 - RNA, 27 nt, Artificial Sequence
  Synthetic Oligonucleotide
ggcacuucguuggcugcaacuguauau

SEQ ID NO: 10322 - RNA, 27 nt, Artificial Sequence
  Synthetic Oligonucleotide
uuccugggccaccuccucaauugaaga

SEQ ID NO: 10323 - RNA, 27 nt, Artificial Sequence
  Synthetic Oligonucleotide
agcuguauccaaggaugcuccggaaug

SEQ ID NO: 10324 - RNA, 27 nt, Artificial Sequence
  Synthetic Oligonucleotide
uaaacauggcuugaaugggaucuuggu

SEQ ID NO: 10325 - RNA, 27 nt, Artificial Sequence
  Synthetic Oligonucleotide
acacugugcagagggugaccacagucu

SEQ ID NO: 10326 - RNA, 27 nt, Artificial Sequence
  Synthetic Oligonucleotide
gaggaaaaauccuuuggccguuuccaa

SEQ ID NO: 10327 - RNA, 27 nt, Artificial Sequence
  Synthetic Oligonucleotide
gagagaauuggaauggguggcgguaau

SEQ ID NO: 10328 - RNA, 27 nt, Artificial Sequence
  Synthetic Oligonucleotide
ugaagaaguggcggaagcugguccuga

SEQ ID NO: 10329 - RNA, 27 nt, Artificial Sequence
  Synthetic Oligonucleotide
auuccccacuucaauacaaaggguguc

SEQ ID NO: 10330 - RNA, 27 nt, Artificial Sequence
  Synthetic Oligonucleotide
auacuaaaggaagaauuccgguuggcc

SEQ ID NO: 10331 - RNA, 27 nt, Artificial Sequence
  Synthetic Oligonucleotide
uguggaagggaagguggaagucuuccu

SEQ ID NO: 10332 - RNA, 27 nt, Artificial Sequence
  Synthetic Oligonucleotide
uaugacuauuacaggucuggggcaaau

SEQ ID NO: 10333 - RNA, 27 nt, Artificial Sequence
  Synthetic Oligonucleotide
ugccacugugagagccugucagucccu

SEQ ID NO: 10334 - RNA, 27 nt, Artificial Sequence
  Synthetic Oligonucleotide
auuggaauggguggcgguaauugguga

SEQ ID NO: 10335 - RNA, 27 nt, Artificial Sequence
  Synthetic Oligonucleotide
ccucaauugaagaaguggcggaagcug

SEQ ID NO: 10336 - RNA, 27 nt, Artificial Sequence
  Synthetic Oligonucleotide
caacucgauggggugccagccacuauu

SEQ ID NO: 10337 - RNA, 27 nt, Artificial Sequence
  Synthetic Oligonucleotide
caccuccucaauugaagaaguggcgga

SEQ ID NO: 10338 - RNA, 27 nt, Artificial Sequence
  Synthetic Oligonucleotide
agaauuggaauggguggcgguaauugg

SEQ ID NO: 10339 - RNA, 27 nt, Artificial Sequence
  Synthetic Oligonucleotide
aggaaaaauccuuuggccguuuccaag

SEQ ID NO: 10340 - RNA, 27 nt, Artificial Sequence
  Synthetic Oligonucleotide
ggaagggaagguggaagucuuccugga

SEQ ID NO: 10341 - RNA, 27 nt, Artificial Sequence
  Synthetic Oligonucleotide
aucagcugggaagauaucaaauggcug

SEQ ID NO: 10342 - RNA, 27 nt, Artificial Sequence
  Synthetic Oligonucleotide
cuccucaauugaagaaguggcggaagc

SEQ ID NO: 10343 - RNA, 27 nt, Artificial Sequence
  Synthetic Oligonucleotide
cgacuucuguuuuaggacagaggguca

SEQ ID NO: 10344 - RNA, 27 nt, Artificial Sequence
  Synthetic Oligonucleotide
agcacuggagagaauuggaaugggugg

SEQ ID NO: 10345 - RNA, 27 nt, Artificial Sequence
  Synthetic Oligonucleotide
accaaucguuuggggcuuagcuuucca

SEQ ID NO: 10346 - RNA, 27 nt, Artificial Sequence
  Synthetic Oligonucleotide
gggccaccuccucaauugaagaagugg

SEQ ID NO: 10347 - RNA, 27 nt, Artificial Sequence
  Synthetic Oligonucleotide
gcuguuaaacauggcuugaaugggauc

SEQ ID NO: 10348 - RNA, 27 nt, Artificial Sequence
  Synthetic Oligonucleotide
acugauguucugaaagcucuggcucuu

SEQ ID NO: 10349 - RNA, 27 nt, Artificial Sequence
  Synthetic Oligonucleotide
gugcguaacagauucaaacugccgcca

SEQ ID NO: 10350 - RNA, 27 nt, Artificial Sequence
  Synthetic Oligonucleotide
gauucaaacugccgccacaacucagga

SEQ ID NO: 10351 - RNA, 27 nt, Artificial Sequence
  Synthetic Oligonucleotide
aauuggaauggguggcgguaauuggug

SEQ ID NO: 10352 - RNA, 27 nt, Artificial Sequence
  Synthetic Oligonucleotide
ugaggaaaaauccuuuggccguuucca

SEQ ID NO: 10353 - RNA, 27 nt, Artificial Sequence
  Synthetic Oligonucleotide
cuggcaggcuaaagugcuguauccuuu

SEQ ID NO: 10354 - RNA, 27 nt, Artificial Sequence
  Synthetic Oligonucleotide
gaugaugccagggaggcuguuaaacau

SEQ ID NO: 10355 - RNA, 27 nt, Artificial Sequence
  Synthetic Oligonucleotide
cuugccacugugagagccugucagucc

SEQ ID NO: 10356 - RNA, 27 nt, Artificial Sequence
  Synthetic Oligonucleotide
gcauuuugagaggugaugaugccaggg

SEQ ID NO: 10357 - RNA, 27 nt, Artificial Sequence
  Synthetic Oligonucleotide
aguuccugggccaccuccucaauugaa

SEQ ID NO: 10358 - RNA, 27 nt, Artificial Sequence
  Synthetic Oligonucleotide
auauaugacuauuacaggucuggggca

SEQ ID NO: 10359 - RNA, 27 nt, Artificial Sequence
  Synthetic Oligonucleotide
gacaguggacuugcugcauauguggcu

SEQ ID NO: 10360 - RNA, 27 nt, Artificial Sequence
  Synthetic Oligonucleotide
uguuuagacaacgucauccccuggcag

SEQ ID NO: 10361 - RNA, 27 nt, Artificial Sequence
  Synthetic Oligonucleotide
uguucugccagaaauuguggaggcugu

SEQ ID NO: 10362 - RNA, 27 nt, Artificial Sequence
  Synthetic Oligonucleotide
aacucgauggggugccagccacuauug

SEQ ID NO: 10363 - RNA, 27 nt, Artificial Sequence
  Synthetic Oligonucleotide
gagaagucaccaagaagcuagugcggc

SEQ ID NO: 10364 - RNA, 27 nt, Artificial Sequence
  Synthetic Oligonucleotide
ggugugcggaaaggcacugauguucug

SEQ ID NO: 10365 - RNA, 27 nt, Artificial Sequence
  Synthetic Oligonucleotide
ggaggcuguuaaacauggcuugaaugg

SEQ ID NO: 10366 - RNA, 27 nt, Artificial Sequence
  Synthetic Oligonucleotide
uuguggaggcuguggaagggaaggugg

SEQ ID NO: 10367 - RNA, 27 nt, Artificial Sequence
  Synthetic Oligonucleotide
cuuggugucgaaucauggggcucgaca

SEQ ID NO: 10368 - RNA, 27 nt, Artificial Sequence
  Synthetic Oligonucleotide
auucaaacugccgccacaacucaggau

SEQ ID NO: 10369 - RNA, 27 nt, Artificial Sequence
  Synthetic Oligonucleotide
gugaugaugccagggaggcuguuaaac

SEQ ID NO: 10370 - RNA, 27 nt, Artificial Sequence
  Synthetic Oligonucleotide
auaugacuauuacaggucuggggcaaa

SEQ ID NO: 10371 - RNA, 27 nt, Artificial Sequence
  Synthetic Oligonucleotide
ucgacaacucgauggggugccagccac

SEQ ID NO: 10372 - RNA, 27 nt, Artificial Sequence
  Synthetic Oligonucleotide
uuggugaggaaaaauccuuuggccguu

SEQ ID NO: 10373 - RNA, 27 nt, Artificial Sequence
  Synthetic Oligonucleotide
cuaaaggaagaauuccgguuggccaug

SEQ ID NO: 10374 - RNA, 27 nt, Artificial Sequence
  Synthetic Oligonucleotide
gcguaacagauucaaacugccgccaca

SEQ ID NO: 10375 - RNA, 27 nt, Artificial Sequence
  Synthetic Oligonucleotide
gcuugccacugugagagccugucaguc

SEQ ID NO: 10376 - RNA, 27 nt, Artificial Sequence
  Synthetic Oligonucleotide
ccugggaacgggcaugauguugaguuc

SEQ ID NO: 10377 - RNA, 27 nt, Artificial Sequence
  Synthetic Oligonucleotide
ucugccagaaauuguggaggcugugga

SEQ ID NO: 10378 - RNA, 27 nt, Artificial Sequence
  Synthetic Oligonucleotide
uauaugacuauuacaggucuggggcaa

SEQ ID NO: 10379 - RNA, 27 nt, Artificial Sequence
  Synthetic Oligonucleotide
gaacgggcaugauguugaguuccuggg

SEQ ID NO: 10380 - RNA, 27 nt, Artificial Sequence
  Synthetic Oligonucleotide
gaggcuguuaaacauggcuugaauggg

SEQ ID NO: 10381 - RNA, 27 nt, Artificial Sequence
  Synthetic Oligonucleotide
ggcacugauguucugaaagcucuggcu

SEQ ID NO: 10382 - RNA, 27 nt, Artificial Sequence
  Synthetic Oligonucleotide
augggaucuuggugucgaaucaugggg

SEQ ID NO: 10383 - RNA, 27 nt, Artificial Sequence
  Synthetic Oligonucleotide
agaccaaucguuuggggcuuagcuuuc

SEQ ID NO: 10384 - RNA, 27 nt, Artificial Sequence
  Synthetic Oligonucleotide
uagacaacgucauccccuggcaggcua

SEQ ID NO: 10385 - RNA, 27 nt, Artificial Sequence
  Synthetic Oligonucleotide
acugugcagagggugaccacagucugu

SEQ ID NO: 10386 - RNA, 27 nt, Artificial Sequence
  Synthetic Oligonucleotide
acucgauggggugccagccacuauuga

SEQ ID NO: 10387 - RNA, 27 nt, Artificial Sequence
  Synthetic Oligonucleotide
uuaccugggcaaccgucuggaugaugu

SEQ ID NO: 10388 - RNA, 27 nt, Artificial Sequence
  Synthetic Oligonucleotide
uggaagcuguauccaaggaugcuccgg

SEQ ID NO: 10389 - RNA, 27 nt, Artificial Sequence
  Synthetic Oligonucleotide
uggugucgaaucauggggcucgacaac

SEQ ID NO: 10390 - RNA, 27 nt, Artificial Sequence
  Synthetic Oligonucleotide
augacuauuacaggucuggggcaaaug

SEQ ID NO: 10391 - RNA, 27 nt, Artificial Sequence
  Synthetic Oligonucleotide
uaccugggcaaccgucuggaugaugug

SEQ ID NO: 10392 - RNA, 27 nt, Artificial Sequence
  Synthetic Oligonucleotide
gugucgaaucauggggcucgacaacuc

SEQ ID NO: 10393 - RNA, 27 nt, Artificial Sequence
  Synthetic Oligonucleotide
ggccaccuccucaauugaagaaguggc

SEQ ID NO: 10394 - RNA, 27 nt, Artificial Sequence
  Synthetic Oligonucleotide
gaggcuguggaagggaagguggaaguc

SEQ ID NO: 10395 - RNA, 27 nt, Artificial Sequence
  Synthetic Oligonucleotide
guuuuaggacagagggucagcaugcca

SEQ ID NO: 10396 - RNA, 27 nt, Artificial Sequence
  Synthetic Oligonucleotide
ggaaaaauccuuuggccguuuccaaga

SEQ ID NO: 10397 - RNA, 27 nt, Artificial Sequence
  Synthetic Oligonucleotide
cugauguucugaaagcucuggcucuug

SEQ ID NO: 10398 - RNA, 27 nt, Artificial Sequence
  Synthetic Oligonucleotide
gacuucuguuuuaggacagagggucag

SEQ ID NO: 10399 - RNA, 27 nt, Artificial Sequence
  Synthetic Oligonucleotide
aagggaagguggaagucuuccuggacg

SEQ ID NO: 10400 - RNA, 27 nt, Artificial Sequence
  Synthetic Oligonucleotide
uuucuccugaggaaaauuuuggagacg

SEQ ID NO: 10401 - RNA, 27 nt, Artificial Sequence
  Synthetic Oligonucleotide
caagaagcuagugcggcaggcagagaa

SEQ ID NO: 10402 - RNA, 27 nt, Artificial Sequence
  Synthetic Oligonucleotide
gcuguggaagggaagguggaagucuuc

SEQ ID NO: 10403 - RNA, 27 nt, Artificial Sequence
  Synthetic Oligonucleotide
cugaggcacuucguuggcugcaacugu

SEQ ID NO: 10404 - RNA, 27 nt, Artificial Sequence
  Synthetic Oligonucleotide
ugugcguaacagauucaaacugccgcc

SEQ ID NO: 10405 - RNA, 27 nt, Artificial Sequence
  Synthetic Oligonucleotide
uccuuuggccguuuccaagaucugaca

SEQ ID NO: 10406 - RNA, 27 nt, Artificial Sequence
  Synthetic Oligonucleotide
ugucgaaucauggggcucgacaacucg

SEQ ID NO: 10407 - RNA, 27 nt, Artificial Sequence
  Synthetic Oligonucleotide
uuuggccguuuccaagaucugacagug

SEQ ID NO: 10408 - RNA, 27 nt, Artificial Sequence
  Synthetic Oligonucleotide
aacgucauccccuggcaggcuaaagug

SEQ ID NO: 10409 - RNA, 27 nt, Artificial Sequence
  Synthetic Oligonucleotide
uggugaggaaaaauccuuuggccguuu

SEQ ID NO: 10410 - RNA, 27 nt, Artificial Sequence
  Synthetic Oligonucleotide
ggugaugaugccagggaggcuguuaaa

SEQ ID NO: 10411 - RNA, 27 nt, Artificial Sequence
  Synthetic Oligonucleotide
acuaaaggaagaauuccgguuggccau

SEQ ID NO: 10412 - RNA, 27 nt, Artificial Sequence
  Synthetic Oligonucleotide
acuucuguuuuaggacagagggucagc

SEQ ID NO: 10413 - RNA, 27 nt, Artificial Sequence
  Synthetic Oligonucleotide
ccuuuggccguuuccaagaucugacag

SEQ ID NO: 10414 - RNA, 27 nt, Artificial Sequence
  Synthetic Oligonucleotide
ccaccuccucaauugaagaaguggcgg

SEQ ID NO: 10415 - RNA, 27 nt, Artificial Sequence
  Synthetic Oligonucleotide
auccuuuggccguuuccaagaucugac

SEQ ID NO: 10416 - RNA, 27 nt, Artificial Sequence
  Synthetic Oligonucleotide
ggugucgaaucauggggcucgacaacu

SEQ ID NO: 10417 - RNA, 27 nt, Artificial Sequence
  Synthetic Oligonucleotide
ggaggcuguggaagggaagguggaagu

SEQ ID NO: 10418 - RNA, 27 nt, Artificial Sequence
  Synthetic Oligonucleotide
auuguggaggcuguggaagggaaggug

SEQ ID NO: 10419 - RNA, 27 nt, Artificial Sequence
  Synthetic Oligonucleotide
ccaaucguuuggggcuuagcuuuccag

SEQ ID NO: 10420 - RNA, 27 nt, Artificial Sequence
  Synthetic Oligonucleotide
gccagaaauuguggaggcuguggaagg

SEQ ID NO: 10421 - RNA, 27 nt, Artificial Sequence
  Synthetic Oligonucleotide
accugggcaaccgucuggaugaugugc

SEQ ID NO: 10422 - RNA, 27 nt, Artificial Sequence
  Synthetic Oligonucleotide
cggaagcugguccugaggcacuucguu

SEQ ID NO: 10423 - RNA, 27 nt, Artificial Sequence
  Synthetic Oligonucleotide
aaacauggcuugaaugggaucuuggug

SEQ ID NO: 10424 - RNA, 27 nt, Artificial Sequence
  Synthetic Oligonucleotide
gaggcacuucguuggcugcaacuguau

SEQ ID NO: 10425 - RNA, 27 nt, Artificial Sequence
  Synthetic Oligonucleotide
cugugagagccugucagucccugggaa

SEQ ID NO: 10426 - RNA, 27 nt, Artificial Sequence
  Synthetic Oligonucleotide
ugaugccagggaggcuguuaaacaugg

SEQ ID NO: 10427 - RNA, 27 nt, Artificial Sequence
  Synthetic Oligonucleotide
cauuggugaggaaaaauccuuuggccg

SEQ ID NO: 10428 - RNA, 27 nt, Artificial Sequence
  Synthetic Oligonucleotide
gccacugugagagccugucagucccug

SEQ ID NO: 10429 - RNA, 27 nt, Artificial Sequence
  Synthetic Oligonucleotide
uggacggcgagcuugccacugugagag

SEQ ID NO: 10430 - RNA, 27 nt, Artificial Sequence
  Synthetic Oligonucleotide
ggaagcugguccugaggcacuucguug

SEQ ID NO: 10431 - RNA, 27 nt, Artificial Sequence
  Synthetic Oligonucleotide
ucccugggaacgggcaugauguugagu

SEQ ID NO: 10432 - RNA, 27 nt, Artificial Sequence
  Synthetic Oligonucleotide
aaugggaucuuggugucgaaucauggg

SEQ ID NO: 10433 - RNA, 27 nt, Artificial Sequence
  Synthetic Oligonucleotide
gaguuccugggccaccuccucaauuga

SEQ ID NO: 10434 - RNA, 27 nt, Artificial Sequence
  Synthetic Oligonucleotide
gaaaaauccuuuggccguuuccaagau

SEQ ID NO: 10435 - RNA, 27 nt, Artificial Sequence
  Synthetic Oligonucleotide
gaagggaagguggaagucuuccuggac

SEQ ID NO: 10436 - RNA, 27 nt, Artificial Sequence
  Synthetic Oligonucleotide
uugaguuccugggccaccuccucaauu

SEQ ID NO: 10437 - RNA, 27 nt, Artificial Sequence
  Synthetic Oligonucleotide
caauugaagaaguggcggaagcugguc

SEQ ID NO: 10438 - RNA, 27 nt, Artificial Sequence
  Synthetic Oligonucleotide
caaucguuuggggcuuagcuuuccagg

SEQ ID NO: 10439 - RNA, 27 nt, Artificial Sequence
  Synthetic Oligonucleotide
cuuuggccguuuccaagaucugacagu

SEQ ID NO: 10440 - RNA, 27 nt, Artificial Sequence
  Synthetic Oligonucleotide
aaggaagaauuccgguuggccauggcu

SEQ ID NO: 10441 - RNA, 27 nt, Artificial Sequence
  Synthetic Oligonucleotide
ccagggaggcuguuaaacauggcuuga

SEQ ID NO: 10442 - RNA, 27 nt, Artificial Sequence
  Synthetic Oligonucleotide
guguuuguggggagaccaaucguuugg

SEQ ID NO: 10443 - RNA, 27 nt, Artificial Sequence
  Synthetic Oligonucleotide
ccagaaauuguggaggcuguggaaggg

SEQ ID NO: 10444 - RNA, 27 nt, Artificial Sequence
  Synthetic Oligonucleotide
ggcaggcuaaagugcuguauccuuuag

SEQ ID NO: 10445 - RNA, 27 nt, Artificial Sequence
  Synthetic Oligonucleotide
cagagaagaugggcuacaaggccauau

SEQ ID NO: 10446 - RNA, 27 nt, Artificial Sequence
  Synthetic Oligonucleotide
agaagucaccaagaagcuagugcggca

SEQ ID NO: 10447 - RNA, 27 nt, Artificial Sequence
  Synthetic Oligonucleotide
auguggacggcgagcuugccacuguga

SEQ ID NO: 10448 - RNA, 27 nt, Artificial Sequence
  Synthetic Oligonucleotide
ccacugugagagccugucagucccugg

SEQ ID NO: 10449 - RNA, 27 nt, Artificial Sequence
  Synthetic Oligonucleotide
acuuuucaauggguguccuaggaaccu

SEQ ID NO: 10450 - RNA, 27 nt, Artificial Sequence
  Synthetic Oligonucleotide
gcuguauccaaggaugcuccggaaugu

SEQ ID NO: 10451 - RNA, 27 nt, Artificial Sequence
  Synthetic Oligonucleotide
auguugaguuccugggccaccuccuca

SEQ ID NO: 10452 - RNA, 27 nt, Artificial Sequence
  Synthetic Oligonucleotide
aaaaauccuuuggccguuuccaagauc

SEQ ID NO: 10453 - RNA, 27 nt, Artificial Sequence
  Synthetic Oligonucleotide
ccuggcaggcuaaagugcuguauccuu

SEQ ID NO: 10454 - RNA, 27 nt, Artificial Sequence
  Synthetic Oligonucleotide
aaaauccuuuggccguuuccaagaucu

SEQ ID NO: 10455 - RNA, 27 nt, Artificial Sequence
  Synthetic Oligonucleotide
gaaauuguggaggcuguggaagggaag

SEQ ID NO: 10456 - RNA, 27 nt, Artificial Sequence
  Synthetic Oligonucleotide
cuggagagaauuggaauggguggcggu

SEQ ID NO: 10457 - RNA, 27 nt, Artificial Sequence
  Synthetic Oligonucleotide
augauguugaguuccugggccaccucc

SEQ ID NO: 10458 - RNA, 27 nt, Artificial Sequence
  Synthetic Oligonucleotide
gauguucugccagaaauuguggaggcu

SEQ ID NO: 10459 - RNA, 27 nt, Artificial Sequence
  Synthetic Oligonucleotide
agaagcuagugcggcaggcagagaaga

SEQ ID NO: 10460 - RNA, 27 nt, Artificial Sequence
  Synthetic Oligonucleotide
ucgaaucauggggcucgacaacucgau

SEQ ID NO: 10461 - RNA, 27 nt, Artificial Sequence
  Synthetic Oligonucleotide
ugccagggaggcuguuaaacauggcuu

SEQ ID NO: 10462 - RNA, 27 nt, Artificial Sequence
  Synthetic Oligonucleotide
cacuggagagaauuggaauggguggcg

SEQ ID NO: 10463 - RNA, 27 nt, Artificial Sequence
  Synthetic Oligonucleotide
gcagagaagaugggcuacaaggccaua

SEQ ID NO: 10464 - RNA, 27 nt, Artificial Sequence
  Synthetic Oligonucleotide
ggagaccaaucguuuggggcuuagcuu

SEQ ID NO: 10465 - RNA, 27 nt, Artificial Sequence
  Synthetic Oligonucleotide
aauuguggaggcuguggaagggaaggu

SEQ ID NO: 10466 - RNA, 27 nt, Artificial Sequence
  Synthetic Oligonucleotide
cgaaucauggggcucgacaacucgaug

SEQ ID NO: 10467 - RNA, 27 nt, Artificial Sequence
  Synthetic Oligonucleotide
guccugaggcacuucguuggcugcaac

SEQ ID NO: 10468 - RNA, 27 nt, Artificial Sequence
  Synthetic Oligonucleotide
agucccugggaacgggcaugauguuga

SEQ ID NO: 10469 - RNA, 27 nt, Artificial Sequence
  Synthetic Oligonucleotide
acugugagagccugucagucccuggga

SEQ ID NO: 10470 - RNA, 27 nt, Artificial Sequence
  Synthetic Oligonucleotide
uggagagaauuggaauggguggcggua

SEQ ID NO: 10471 - RNA, 27 nt, Artificial Sequence
  Synthetic Oligonucleotide
auggcucugagugggugccagaaugug

SEQ ID NO: 10472 - RNA, 27 nt, Artificial Sequence
  Synthetic Oligonucleotide
gaagucaccaagaagcuagugcggcag

SEQ ID NO: 10473 - RNA, 27 nt, Artificial Sequence
  Synthetic Oligonucleotide
uaaaggaagaauuccgguuggccaugg

SEQ ID NO: 10474 - RNA, 27 nt, Artificial Sequence
  Synthetic Oligonucleotide
uuggccguuuccaagaucugacagugc

SEQ ID NO: 10475 - RNA, 27 nt, Artificial Sequence
  Synthetic Oligonucleotide
aauccuuuggccguuuccaagaucuga

SEQ ID NO: 10476 - RNA, 27 nt, Artificial Sequence
  Synthetic Oligonucleotide
cggcaggcagagaagaugggcuacaag

SEQ ID NO: 10477 - RNA, 27 nt, Artificial Sequence
  Synthetic Oligonucleotide
ugugagagccugucagucccugggaac

SEQ ID NO: 10478 - RNA, 27 nt, Artificial Sequence
  Synthetic Oligonucleotide
guucugccagaaauuguggaggcugug

SEQ ID NO: 10479 - RNA, 27 nt, Artificial Sequence
  Synthetic Oligonucleotide
aagaagcuagugcggcaggcagagaag

SEQ ID NO: 10480 - RNA, 27 nt, Artificial Sequence
  Synthetic Oligonucleotide
agauucaaacugccgccacaacucagg

SEQ ID NO: 10481 - RNA, 27 nt, Artificial Sequence
  Synthetic Oligonucleotide
uguuuguggggagaccaaucguuuggg

SEQ ID NO: 10482 - RNA, 27 nt, Artificial Sequence
  Synthetic Oligonucleotide
uguuuuaggacagagggucagcaugcc

SEQ ID NO: 10483 - RNA, 27 nt, Artificial Sequence
  Synthetic Oligonucleotide
agggaagguggaagucuuccuggacgg

SEQ ID NO: 10484 - RNA, 27 nt, Artificial Sequence
  Synthetic Oligonucleotide
auuggugaggaaaaauccuuuggccgu

SEQ ID NO: 10485 - RNA, 27 nt, Artificial Sequence
  Synthetic Oligonucleotide
agacaacgucauccccuggcaggcuaa

SEQ ID NO: 10486 - RNA, 27 nt, Artificial Sequence
  Synthetic Oligonucleotide
guuuagacaacgucauccccuggcagg

SEQ ID NO: 10487 - RNA, 27 nt, Artificial Sequence
  Synthetic Oligonucleotide
ggugaggaaaaauccuuuggccguuuc

SEQ ID NO: 10488 - RNA, 27 nt, Artificial Sequence
  Synthetic Oligonucleotide
ggcaggcagagaagaugggcuacaagg

SEQ ID NO: 10489 - RNA, 27 nt, Artificial Sequence
  Synthetic Oligonucleotide
gccaccuccucaauugaagaaguggcg

SEQ ID NO: 10490 - RNA, 27 nt, Artificial Sequence
  Synthetic Oligonucleotide
caugauguugaguuccugggccaccuc

SEQ ID NO: 10491 - RNA, 27 nt, Artificial Sequence
  Synthetic Oligonucleotide
ggagagaauuggaauggguggcgguaa

SEQ ID NO: 10492 - RNA, 27 nt, Artificial Sequence
  Synthetic Oligonucleotide
ccuccucaauugaagaaguggcggaag

SEQ ID NO: 10493 - RNA, 27 nt, Artificial Sequence
  Synthetic Oligonucleotide
acuggagagaauuggaauggguggcgg

SEQ ID NO: 10494 - RNA, 27 nt, Artificial Sequence
  Synthetic Oligonucleotide
uccccuggcaggcuaaagugcuguauc

SEQ ID NO: 10495 - RNA, 27 nt, Artificial Sequence
  Synthetic Oligonucleotide
uggaggcuguggaagggaagguggaag

SEQ ID NO: 10496 - RNA, 27 nt, Artificial Sequence
  Synthetic Oligonucleotide
cauggcucugagugggugccagaaugu

SEQ ID NO: 10497 - RNA, 27 nt, Artificial Sequence
  Synthetic Oligonucleotide
aagucaccaagaagcuagugcggcagg

SEQ ID NO: 10498 - RNA, 27 nt, Artificial Sequence
  Synthetic Oligonucleotide
uugaagaaguggcggaagcugguccug

SEQ ID NO: 10499 - RNA, 27 nt, Artificial Sequence
  Synthetic Oligonucleotide
ugaguuccugggccaccuccucaauug

SEQ ID NO: 10500 - RNA, 27 nt, Artificial Sequence
  Synthetic Oligonucleotide
uccugaggcacuucguuggcugcaacu

SEQ ID NO: 10501 - RNA, 27 nt, Artificial Sequence
  Synthetic Oligonucleotide
guuccugggccaccuccucaauugaag

SEQ ID NO: 10502 - RNA, 27 nt, Artificial Sequence
  Synthetic Oligonucleotide
uguggaggcuguggaagggaaggugga

SEQ ID NO: 10503 - RNA, 27 nt, Artificial Sequence
  Synthetic Oligonucleotide
aucuuggugucgaaucauggggcucga

SEQ ID NO: 10504 - RNA, 27 nt, Artificial Sequence
  Synthetic Oligonucleotide
guggaggcuguggaagggaagguggaa

SEQ ID NO: 10505 - RNA, 27 nt, Artificial Sequence
  Synthetic Oligonucleotide
ugggaucuuggugucgaaucauggggc

SEQ ID NO: 10506 - RNA, 27 nt, Artificial Sequence
  Synthetic Oligonucleotide
gucccugggaacgggcaugauguugag

SEQ ID NO: 10507 - RNA, 27 nt, Artificial Sequence
  Synthetic Oligonucleotide
uuuugagaggugaugaugccagggagg

SEQ ID NO: 10508 - RNA, 27 nt, Artificial Sequence
  Synthetic Oligonucleotide
cauggcuugaaugggaucuuggugucg

SEQ ID NO: 10509 - RNA, 27 nt, Artificial Sequence
  Synthetic Oligonucleotide
ccauggcucugagugggugccagaaug

SEQ ID NO: 10510 - RNA, 27 nt, Artificial Sequence
  Synthetic Oligonucleotide
gagaggugaugaugccagggaggcugu

SEQ ID NO: 10511 - RNA, 27 nt, Artificial Sequence
  Synthetic Oligonucleotide
gcgagcuugccacugugagagccuguc

SEQ ID NO: 10512 - RNA, 27 nt, Artificial Sequence
  Synthetic Oligonucleotide
uguugaguuccugggccaccuccucaa

SEQ ID NO: 10513 - RNA, 27 nt, Artificial Sequence
  Synthetic Oligonucleotide
cggcgagcuugccacugugagagccug

SEQ ID NO: 10514 - RNA, 27 nt, Artificial Sequence
  Synthetic Oligonucleotide
cauguggacggcgagcuugccacugug

SEQ ID NO: 10515 - RNA, 27 nt, Artificial Sequence
  Synthetic Oligonucleotide
aaauuguggaggcuguggaagggaagg

SEQ ID NO: 10516 - RNA, 27 nt, Artificial Sequence
  Synthetic Oligonucleotide
aauugaagaaguggcggaagcuggucc

SEQ ID NO: 10517 - RNA, 27 nt, Artificial Sequence
  Synthetic Oligonucleotide
gacaacucgauggggugccagccacua

SEQ ID NO: 10518 - RNA, 27 nt, Artificial Sequence
  Synthetic Oligonucleotide
aggaagaauuccgguuggccauggcuc

SEQ ID NO: 10519 - RNA, 27 nt, Artificial Sequence
  Synthetic Oligonucleotide
aggcagagaagaugggcuacaaggcca

SEQ ID NO: 10520 - RNA, 27 nt, Artificial Sequence
  Synthetic Oligonucleotide
gaccaaucguuuggggcuuagcuuucc

SEQ ID NO: 10521 - RNA, 27 nt, Artificial Sequence
  Synthetic Oligonucleotide
gugaggaaaaauccuuuggccguuucc

SEQ ID NO: 10522 - RNA, 27 nt, Artificial Sequence
  Synthetic Oligonucleotide
caacgucauccccuggcaggcuaaagu

SEQ ID NO: 10523 - RNA, 27 nt, Artificial Sequence
  Synthetic Oligonucleotide
cacugugagagccugucagucccuggg

SEQ ID NO: 10524 - RNA, 27 nt, Artificial Sequence
  Synthetic Oligonucleotide
acgucauccccuggcaggcuaaagugc

SEQ ID NO: 10525 - RNA, 27 nt, Artificial Sequence
  Synthetic Oligonucleotide
gacaacgucauccccuggcaggcuaaa

SEQ ID NO: 10526 - RNA, 27 nt, Artificial Sequence
  Synthetic Oligonucleotide
gaaucauggggcucgacaacucgaugg

SEQ ID NO: 10527 - RNA, 27 nt, Artificial Sequence
  Synthetic Oligonucleotide
aaauccuuuggccguuuccaagaucug

SEQ ID NO: 10528 - RNA, 27 nt, Artificial Sequence
  Synthetic Oligonucleotide
ccccuggcaggcuaaagugcuguaucc

SEQ ID NO: 10529 - RNA, 27 nt, Artificial Sequence
  Synthetic Oligonucleotide
ucuuggugucgaaucauggggcucgac

SEQ ID NO: 10530 - RNA, 27 nt, Artificial Sequence
  Synthetic Oligonucleotide
ucauguggacggcgagcuugccacugu

SEQ ID NO: 10531 - RNA, 27 nt, Artificial Sequence
  Synthetic Oligonucleotide
aagaauuccgguuggccauggcucuga

SEQ ID NO: 10532 - RNA, 27 nt, Artificial Sequence
  Synthetic Oligonucleotide
ucaccaagaagcuagugcggcaggcag

SEQ ID NO: 10533 - RNA, 27 nt, Artificial Sequence
  Synthetic Oligonucleotide
ggaagguggaagucuuccuggacgggg

SEQ ID NO: 10534 - RNA, 27 nt, Artificial Sequence
  Synthetic Oligonucleotide
ugauguugaguuccugggccaccuccu

SEQ ID NO: 10535 - RNA, 27 nt, Artificial Sequence
  Synthetic Oligonucleotide
accuuaccugggcaaccgucuggauga

SEQ ID NO: 10536 - RNA, 27 nt, Artificial Sequence
  Synthetic Oligonucleotide
cgacaacucgauggggugccagccacu

SEQ ID NO: 10537 - RNA, 27 nt, Artificial Sequence
  Synthetic Oligonucleotide
ugagaggugaugaugccagggaggcug

SEQ ID NO: 10538 - RNA, 27 nt, Artificial Sequence
  Synthetic Oligonucleotide
cugggcaaccgucuggaugaugugcgu

SEQ ID NO: 10539 - RNA, 27 nt, Artificial Sequence
  Synthetic Oligonucleotide
cccuggcaggcuaaagugcuguauccu

SEQ ID NO: 10540 - RNA, 27 nt, Artificial Sequence
  Synthetic Oligonucleotide
ggcgagcuugccacugugagagccugu

SEQ ID NO: 10541 - RNA, 27 nt, Artificial Sequence
  Synthetic Oligonucleotide
gaagaaguggcggaagcugguccugag

SEQ ID NO: 10542 - RNA, 27 nt, Artificial Sequence
  Synthetic Oligonucleotide
agcuagugcggcaggcagagaagaugg

SEQ ID NO: 10543 - RNA, 27 nt, Artificial Sequence
  Synthetic Oligonucleotide
guuuguggggagaccaaucguuugggg

SEQ ID NO: 10544 - RNA, 27 nt, Artificial Sequence
  Synthetic Oligonucleotide
agaauuccgguuggccauggcucugag

SEQ ID NO: 10545 - RNA, 27 nt, Artificial Sequence
  Synthetic Oligonucleotide
gcaugauguugaguuccugggccaccu

SEQ ID NO: 10546 - RNA, 27 nt, Artificial Sequence
  Synthetic Oligonucleotide
gaggugaugaugccagggaggcuguua

SEQ ID NO: 10547 - RNA, 27 nt, Artificial Sequence
  Synthetic Oligonucleotide
gaagcuagugcggcaggcagagaagau

SEQ ID NO: 10548 - RNA, 27 nt, Artificial Sequence
  Synthetic Oligonucleotide
acaacucgauggggugccagccacuau

SEQ ID NO: 10549 - RNA, 27 nt, Artificial Sequence
  Synthetic Oligonucleotide
ggacggcgagcuugccacugugagagc

SEQ ID NO: 10550 - RNA, 27 nt, Artificial Sequence
  Synthetic Oligonucleotide
aaaggaagaauuccgguuggccauggc

SEQ ID NO: 10551 - RNA, 27 nt, Artificial Sequence
  Synthetic Oligonucleotide
ggcucgacaacucgauggggugccagc

SEQ ID NO: 10552 - RNA, 27 nt, Artificial Sequence
  Synthetic Oligonucleotide
gcacuggagagaauuggaauggguggc

SEQ ID NO: 10553 - RNA, 27 nt, Artificial Sequence
  Synthetic Oligonucleotide
agaggugaugaugccagggaggcuguu

SEQ ID NO: 10554 - RNA, 27 nt, Artificial Sequence
  Synthetic Oligonucleotide
uucugccagaaauuguggaggcugugg

SEQ ID NO: 10555 - RNA, 27 nt, Artificial Sequence
  Synthetic Oligonucleotide
auugaagaaguggcggaagcugguccu

SEQ ID NO: 10556 - RNA, 27 nt, Artificial Sequence
  Synthetic Oligonucleotide
gggagaccaaucguuuggggcuuagcu

SEQ ID NO: 10557 - RNA, 27 nt, Artificial Sequence
  Synthetic Oligonucleotide
guggacggcgagcuugccacugugaga

SEQ ID NO: 10558 - RNA, 27 nt, Artificial Sequence
  Synthetic Oligonucleotide
cacaccuuaccugggcaaccgucugga

SEQ ID NO: 10559 - RNA, 27 nt, Artificial Sequence
  Synthetic Oligonucleotide
gggaucuuggugucgaaucauggggcu

SEQ ID NO: 10560 - RNA, 27 nt, Artificial Sequence
  Synthetic Oligonucleotide
caccaagaagcuagugcggcaggcaga

SEQ ID NO: 10561 - RNA, 27 nt, Artificial Sequence
  Synthetic Oligonucleotide
guugaguuccugggccaccuccucaau

SEQ ID NO: 10562 - RNA, 27 nt, Artificial Sequence
  Synthetic Oligonucleotide
ucagucccugggaacgggcaugauguu

SEQ ID NO: 10563 - RNA, 27 nt, Artificial Sequence
  Synthetic Oligonucleotide
cucgacaacucgauggggugccagcca

SEQ ID NO: 10564 - RNA, 27 nt, Artificial Sequence
  Synthetic Oligonucleotide
ggaucuuggugucgaaucauggggcuc

SEQ ID NO: 10565 - RNA, 27 nt, Artificial Sequence
  Synthetic Oligonucleotide
aagcuagugcggcaggcagagaagaug

SEQ ID NO: 10566 - RNA, 27 nt, Artificial Sequence
  Synthetic Oligonucleotide
gacggcgagcuugccacugugagagcc

SEQ ID NO: 10567 - RNA, 27 nt, Artificial Sequence
  Synthetic Oligonucleotide
ccugaggcacuucguuggcugcaacug

SEQ ID NO: 10568 - RNA, 27 nt, Artificial Sequence
  Synthetic Oligonucleotide
cgggcaugauguugaguuccugggcca

SEQ ID NO: 10569 - RNA, 27 nt, Artificial Sequence
  Synthetic Oligonucleotide
acggcgagcuugccacugugagagccu

SEQ ID NO: 10570 - RNA, 27 nt, Artificial Sequence
  Synthetic Oligonucleotide
gugagagccugucagucccugggaacg

SEQ ID NO: 10571 - RNA, 27 nt, Artificial Sequence
  Synthetic Oligonucleotide
ugucagucccugggaacgggcaugaug

SEQ ID NO: 10572 - RNA, 27 nt, Artificial Sequence
  Synthetic Oligonucleotide
ggccguuuccaagaucugacagugcac

SEQ ID NO: 10573 - RNA, 27 nt, Artificial Sequence
  Synthetic Oligonucleotide
ggcagagaagaugggcuacaaggccau

SEQ ID NO: 10574 - RNA, 27 nt, Artificial Sequence
  Synthetic Oligonucleotide
aacgggcaugauguugaguuccugggc

SEQ ID NO: 10575 - RNA, 27 nt, Artificial Sequence
  Synthetic Oligonucleotide
cuuaccugggcaaccgucuggaugaug

SEQ ID NO: 10576 - RNA, 27 nt, Artificial Sequence
  Synthetic Oligonucleotide
cagucccugggaacgggcaugauguug

SEQ ID NO: 10577 - RNA, 27 nt, Artificial Sequence
  Synthetic Oligonucleotide
gaagcugguccugaggcacuucguugg

SEQ ID NO: 10578 - RNA, 27 nt, Artificial Sequence
  Synthetic Oligonucleotide
gggaagguggaagucuuccuggacggg

SEQ ID NO: 10579 - RNA, 27 nt, Artificial Sequence
  Synthetic Oligonucleotide
gucagucccugggaacgggcaugaugu

SEQ ID NO: 10580 - RNA, 27 nt, Artificial Sequence
  Synthetic Oligonucleotide
ugagagccugucagucccugggaacgg

SEQ ID NO: 10581 - RNA, 27 nt, Artificial Sequence
  Synthetic Oligonucleotide
caccuuaccugggcaaccgucuggaug

SEQ ID NO: 10582 - RNA, 27 nt, Artificial Sequence
  Synthetic Oligonucleotide
ucauggggcucgacaacucgauggggu

SEQ ID NO: 10583 - RNA, 27 nt, Artificial Sequence
  Synthetic Oligonucleotide
ccaugcagcgcauggcucauguggacg

SEQ ID NO: 10584 - RNA, 27 nt, Artificial Sequence
  Synthetic Oligonucleotide
ggggagaccaaucguuuggggcuuagc

SEQ ID NO: 10585 - RNA, 27 nt, Artificial Sequence
  Synthetic Oligonucleotide
ucauccccuggcaggcuaaagugcugu

SEQ ID NO: 10586 - RNA, 27 nt, Artificial Sequence
  Synthetic Oligonucleotide
uuguggggagaccaaucguuuggggcu

SEQ ID NO: 10587 - RNA, 27 nt, Artificial Sequence
  Synthetic Oligonucleotide
ccaagaagcuagugcggcaggcagaga

SEQ ID NO: 10588 - RNA, 27 nt, Artificial Sequence
  Synthetic Oligonucleotide
acaacgucauccccuggcaggcuaaag

SEQ ID NO: 10589 - RNA, 27 nt, Artificial Sequence
  Synthetic Oligonucleotide
acgggcaugauguugaguuccugggcc

SEQ ID NO: 10590 - RNA, 27 nt, Artificial Sequence
  Synthetic Oligonucleotide
uuugagaggugaugaugccagggaggc

SEQ ID NO: 10591 - RNA, 27 nt, Artificial Sequence
  Synthetic Oligonucleotide
auguucugaaagcucuggcucuuggcg

SEQ ID NO: 10592 - RNA, 27 nt, Artificial Sequence
  Synthetic Oligonucleotide
uguggacggcgagcuugccacugugag

SEQ ID NO: 10593 - RNA, 27 nt, Artificial Sequence
  Synthetic Oligonucleotide
gccagggaggcuguuaaacauggcuug

SEQ ID NO: 10594 - RNA, 27 nt, Artificial Sequence
  Synthetic Oligonucleotide
uuagacaacgucauccccuggcaggcu

SEQ ID NO: 10595 - RNA, 27 nt, Artificial Sequence
  Synthetic Oligonucleotide
ccugggcaaccgucuggaugaugugcg

SEQ ID NO: 10596 - RNA, 27 nt, Artificial Sequence
  Synthetic Oligonucleotide
cauccccuggcaggcuaaagugcugua

SEQ ID NO: 10597 - RNA, 19 nt, Artificial Sequence
  Synthetic Oligonucleotide
ggaaauauauuaacuguua

SEQ ID NO: 10598 - RNA, 19 nt, Artificial Sequence
  Synthetic Oligonucleotide
augaucucauuguuuauua

SEQ ID NO: 10599 - RNA, 19 nt, Artificial Sequence
  Synthetic Oligonucleotide
gauaaugaucucauuguuu

SEQ ID NO: 10600 - RNA, 19 nt, Artificial Sequence
  Synthetic Oligonucleotide
gaaauauauuaacuguuaa

SEQ ID NO: 10601 - RNA, 19 nt, Artificial Sequence
  Synthetic Oligonucleotide
cagcauguauuacuugaca

SEQ ID NO: 10602 - RNA, 19 nt, Artificial Sequence
  Synthetic Oligonucleotide
cuggaaauauauuaacugu

SEQ ID NO: 10603 - RNA, 19 nt, Artificial Sequence
  Synthetic Oligonucleotide
agauaaugaucucauuguu

SEQ ID NO: 10604 - RNA, 19 nt, Artificial Sequence
  Synthetic Oligonucleotide
auuuugaaaccaguacuuu

SEQ ID NO: 10605 - RNA, 19 nt, Artificial Sequence
  Synthetic Oligonucleotide
gaaaccaguacuuuaucau

SEQ ID NO: 10606 - RNA, 19 nt, Artificial Sequence
  Synthetic Oligonucleotide
uggaaauauauuaacuguu

SEQ ID NO: 10607 - RNA, 19 nt, Artificial Sequence
  Synthetic Oligonucleotide
caaaauagcaaucccuuuu

SEQ ID NO: 10608 - RNA, 19 nt, Artificial Sequence
  Synthetic Oligonucleotide
aaugaucucauuguuuauu

SEQ ID NO: 10609 - RNA, 19 nt, Artificial Sequence
  Synthetic Oligonucleotide
cagugguucuuaaauugua

SEQ ID NO: 10610 - RNA, 19 nt, Artificial Sequence
  Synthetic Oligonucleotide
acuuucauccuggaaauau

SEQ ID NO: 10611 - RNA, 19 nt, Artificial Sequence
  Synthetic Oligonucleotide
augaacaacaugcuaaauc

SEQ ID NO: 10612 - RNA, 19 nt, Artificial Sequence
  Synthetic Oligonucleotide
gaaaagauaaugaucucau

SEQ ID NO: 10613 - RNA, 19 nt, Artificial Sequence
  Synthetic Oligonucleotide
gugauacuucuuugaaugu

SEQ ID NO: 10614 - RNA, 19 nt, Artificial Sequence
  Synthetic Oligonucleotide
aagacugacaucauugcca

SEQ ID NO: 10615 - RNA, 19 nt, Artificial Sequence
  Synthetic Oligonucleotide
gacuuucauccuggaaaua

SEQ ID NO: 10616 - RNA, 19 nt, Artificial Sequence
  Synthetic Oligonucleotide
auccuggaaauauauuaac

SEQ ID NO: 10617 - RNA, 19 nt, Artificial Sequence
  Synthetic Oligonucleotide
gaagacugacaucauugcc

SEQ ID NO: 10618 - RNA, 19 nt, Artificial Sequence
  Synthetic Oligonucleotide
uuggugauacuucuuugaa

SEQ ID NO: 10619 - RNA, 19 nt, Artificial Sequence
  Synthetic Oligonucleotide
cauuguuuauuaaccugua

SEQ ID NO: 10620 - RNA, 19 nt, Artificial Sequence
  Synthetic Oligonucleotide
gugaaaagauaaugaucuc

SEQ ID NO: 10621 - RNA, 19 nt, Artificial Sequence
  Synthetic Oligonucleotide
ucauccuggaaauauauua

SEQ ID NO: 10622 - RNA, 19 nt, Artificial Sequence
  Synthetic Oligonucleotide
aaaauagcaaucccuuuua

SEQ ID NO: 10623 - RNA, 19 nt, Artificial Sequence
  Synthetic Oligonucleotide
auaaugaucucauuguuua

SEQ ID NO: 10624 - RNA, 19 nt, Artificial Sequence
  Synthetic Oligonucleotide
uucauccuggaaauauauu

SEQ ID NO: 10625 - RNA, 19 nt, Artificial Sequence
  Synthetic Oligonucleotide
gcaaucccuuuuauuucau

SEQ ID NO: 10626 - RNA, 19 nt, Artificial Sequence
  Synthetic Oligonucleotide
aaauagcaaucccuuuuau

SEQ ID NO: 10627 - RNA, 19 nt, Artificial Sequence
  Synthetic Oligonucleotide
agcauguauuacuugacaa

SEQ ID NO: 10628 - RNA, 19 nt, Artificial Sequence
  Synthetic Oligonucleotide
aauuggugauacuucuuug

SEQ ID NO: 10629 - RNA, 19 nt, Artificial Sequence
  Synthetic Oligonucleotide
gauagcaauaaccugugaa

SEQ ID NO: 10630 - RNA, 19 nt, Artificial Sequence
  Synthetic Oligonucleotide
auuguuuauuaaccuguau

SEQ ID NO: 10631 - RNA, 19 nt, Artificial Sequence
  Synthetic Oligonucleotide
caacucaggaugaaaaauu

SEQ ID NO: 10632 - RNA, 19 nt, Artificial Sequence
  Synthetic Oligonucleotide
cauccuggaaauauauuaa

SEQ ID NO: 10633 - RNA, 19 nt, Artificial Sequence
  Synthetic Oligonucleotide
ggauagcaauaaccuguga

SEQ ID NO: 10634 - RNA, 19 nt, Artificial Sequence
  Synthetic Oligonucleotide
auuggugauacuucuuuga

SEQ ID NO: 10635 - RNA, 19 nt, Artificial Sequence
  Synthetic Oligonucleotide
gaaaaauuuugaaaccagu

SEQ ID NO: 10636 - RNA, 19 nt, Artificial Sequence
  Synthetic Oligonucleotide
uuuguaucaaugauuauga

SEQ ID NO: 10637 - RNA, 19 nt, Artificial Sequence
  Synthetic Oligonucleotide
cuaauuuguaucaaugauu

SEQ ID NO: 10638 - RNA, 19 nt, Artificial Sequence
  Synthetic Oligonucleotide
cugaauauauccaaauguu

SEQ ID NO: 10639 - RNA, 19 nt, Artificial Sequence
  Synthetic Oligonucleotide
acagugguucuuaaauugu

SEQ ID NO: 10640 - RNA, 19 nt, Artificial Sequence
  Synthetic Oligonucleotide
aucucauuguuuauuaacc

SEQ ID NO: 10641 - RNA, 19 nt, Artificial Sequence
  Synthetic Oligonucleotide
ucauuguuuauuaaccugu

SEQ ID NO: 10642 - RNA, 19 nt, Artificial Sequence
  Synthetic Oligonucleotide
uuuuucagcauguauuacu

SEQ ID NO: 10643 - RNA, 19 nt, Artificial Sequence
  Synthetic Oligonucleotide
ccaguacuuuaucauuuuc

SEQ ID NO: 10644 - RNA, 19 nt, Artificial Sequence
  Synthetic Oligonucleotide
aaugccugauucacaacuu

SEQ ID NO: 10645 - RNA, 19 nt, Artificial Sequence
  Synthetic Oligonucleotide
aauuuugaaaccaguacuu

SEQ ID NO: 10646 - RNA, 19 nt, Artificial Sequence
  Synthetic Oligonucleotide
agcaaucccuuuuauuuca

SEQ ID NO: 10647 - RNA, 19 nt, Artificial Sequence
  Synthetic Oligonucleotide
gcuaauuuguaucaaugau

SEQ ID NO: 10648 - RNA, 19 nt, Artificial Sequence
  Synthetic Oligonucleotide
ccuggaaauauauuaacug

SEQ ID NO: 10649 - RNA, 19 nt, Artificial Sequence
  Synthetic Oligonucleotide
aagauaaugaucucauugu

SEQ ID NO: 10650 - RNA, 19 nt, Artificial Sequence
  Synthetic Oligonucleotide
gaauauauccaaauguuuu

SEQ ID NO: 10651 - RNA, 19 nt, Artificial Sequence
  Synthetic Oligonucleotide
auuuguaucaaugauuaug

SEQ ID NO: 10652 - RNA, 19 nt, Artificial Sequence
  Synthetic Oligonucleotide
ugacaucauugccaauugu

SEQ ID NO: 10653 - RNA, 19 nt, Artificial Sequence
  Synthetic Oligonucleotide
ugauuaugaacaacaugcu

SEQ ID NO: 10654 - RNA, 19 nt, Artificial Sequence
  Synthetic Oligonucleotide
aauagcaaucccuuuuauu

SEQ ID NO: 10655 - RNA, 19 nt, Artificial Sequence
  Synthetic Oligonucleotide
auagcaauaaccugugaaa

SEQ ID NO: 10656 - RNA, 19 nt, Artificial Sequence
  Synthetic Oligonucleotide
uaauuuguaucaaugauua

SEQ ID NO: 10657 - RNA, 19 nt, Artificial Sequence
  Synthetic Oligonucleotide
aacaacaugcuaaaucagu

SEQ ID NO: 10658 - RNA, 19 nt, Artificial Sequence
  Synthetic Oligonucleotide
auuucauugcuuuugacuu

SEQ ID NO: 10659 - RNA, 19 nt, Artificial Sequence
  Synthetic Oligonucleotide
auuguaagcucagguucaa

SEQ ID NO: 10660 - RNA, 19 nt, Artificial Sequence
  Synthetic Oligonucleotide
cugacaucauugccaauug

SEQ ID NO: 10661 - RNA, 19 nt, Artificial Sequence
  Synthetic Oligonucleotide
ugaucucauuguuuauuaa

SEQ ID NO: 10662 - RNA, 19 nt, Artificial Sequence
  Synthetic Oligonucleotide
auuaugaacaacaugcuaa

SEQ ID NO: 10663 - RNA, 19 nt, Artificial Sequence
  Synthetic Oligonucleotide
auggacuuucauccuggaa

SEQ ID NO: 10664 - RNA, 19 nt, Artificial Sequence
  Synthetic Oligonucleotide
aguguugguaaugccugau

SEQ ID NO: 10665 - RNA, 19 nt, Artificial Sequence
  Synthetic Oligonucleotide
guaucaaugauuaugaaca

SEQ ID NO: 10666 - RNA, 19 nt, Artificial Sequence
  Synthetic Oligonucleotide
aucccuuuuauuucauugc

SEQ ID NO: 10667 - RNA, 19 nt, Artificial Sequence
  Synthetic Oligonucleotide
guaauuggugauacuucuu

SEQ ID NO: 10668 - RNA, 19 nt, Artificial Sequence
  Synthetic Oligonucleotide
gacaagacauuggugagga

SEQ ID NO: 10669 - RNA, 19 nt, Artificial Sequence
  Synthetic Oligonucleotide
uagcaaucccuuuuauuuc

SEQ ID NO: 10670 - RNA, 19 nt, Artificial Sequence
  Synthetic Oligonucleotide
uugguaaugccugauucac

SEQ ID NO: 10671 - RNA, 19 nt, Artificial Sequence
  Synthetic Oligonucleotide
auuaacuguuaaaaagaaa

SEQ ID NO: 10672 - RNA, 19 nt, Artificial Sequence
  Synthetic Oligonucleotide
caggaugaaaaauuuugaa

SEQ ID NO: 10673 - RNA, 19 nt, Artificial Sequence
  Synthetic Oligonucleotide
gggauagcaauaaccugug

SEQ ID NO: 10674 - RNA, 19 nt, Artificial Sequence
  Synthetic Oligonucleotide
aaauuuugaaaccaguacu

SEQ ID NO: 10675 - RNA, 19 nt, Artificial Sequence
  Synthetic Oligonucleotide
ggugauacuucuuugaaug

SEQ ID NO: 10676 - RNA, 19 nt, Artificial Sequence
  Synthetic Oligonucleotide
ucaaugauuaugaacaaca

SEQ ID NO: 10677 - RNA, 19 nt, Artificial Sequence
  Synthetic Oligonucleotide
aagcucagguucaaagugu

SEQ ID NO: 10678 - RNA, 19 nt, Artificial Sequence
  Synthetic Oligonucleotide
aauuuguaucaaugauuau

SEQ ID NO: 10679 - RNA, 19 nt, Artificial Sequence
  Synthetic Oligonucleotide
uuucauugcuuuugacuuu

SEQ ID NO: 10680 - RNA, 19 nt, Artificial Sequence
  Synthetic Oligonucleotide
ugaauauauccaaauguuu

SEQ ID NO: 10681 - RNA, 19 nt, Artificial Sequence
  Synthetic Oligonucleotide
gauuaugaacaacaugcua

SEQ ID NO: 10682 - RNA, 19 nt, Artificial Sequence
  Synthetic Oligonucleotide
auauuaacuguuaaaaaga

SEQ ID NO: 10683 - RNA, 19 nt, Artificial Sequence
  Synthetic Oligonucleotide
ugguaaugccugauucaca

SEQ ID NO: 10684 - RNA, 19 nt, Artificial Sequence
  Synthetic Oligonucleotide
gaugaaaaauuuugaaacc

SEQ ID NO: 10685 - RNA, 19 nt, Artificial Sequence
  Synthetic Oligonucleotide
uugaaaccaguacuuuauc

SEQ ID NO: 10686 - RNA, 19 nt, Artificial Sequence
  Synthetic Oligonucleotide
ccaaagucuauauaugacu

SEQ ID NO: 10687 - RNA, 19 nt, Artificial Sequence
  Synthetic Oligonucleotide
cucaggaugaaaaauuuug

SEQ ID NO: 10688 - RNA, 19 nt, Artificial Sequence
  Synthetic Oligonucleotide
auuaaccuguauucuguuu

SEQ ID NO: 10689 - RNA, 19 nt, Artificial Sequence
  Synthetic Oligonucleotide
ucagcauguauuacuugac

SEQ ID NO: 10690 - RNA, 19 nt, Artificial Sequence
  Synthetic Oligonucleotide
caauauuuucccaucugua

SEQ ID NO: 10691 - RNA, 19 nt, Artificial Sequence
  Synthetic Oligonucleotide
cuguaauuccccacuucaa

SEQ ID NO: 10692 - RNA, 19 nt, Artificial Sequence
  Synthetic Oligonucleotide
aaaguguugguaaugccug

SEQ ID NO: 10693 - RNA, 19 nt, Artificial Sequence
  Synthetic Oligonucleotide
aagugcuguauccuuuagu

SEQ ID NO: 10694 - RNA, 19 nt, Artificial Sequence
  Synthetic Oligonucleotide
cuuucauccuggaaauaua

SEQ ID NO: 10695 - RNA, 19 nt, Artificial Sequence
  Synthetic Oligonucleotide
ggaugaugugcguaacaga

SEQ ID NO: 10696 - RNA, 19 nt, Artificial Sequence
  Synthetic Oligonucleotide
ugaaagucaucgacaagac

SEQ ID NO: 10697 - RNA, 19 nt, Artificial Sequence
  Synthetic Oligonucleotide
ucaggaugaaaaauuuuga

SEQ ID NO: 10698 - RNA, 19 nt, Artificial Sequence
  Synthetic Oligonucleotide
aaauauauuaacuguuaaa

SEQ ID NO: 10699 - RNA, 19 nt, Artificial Sequence
  Synthetic Oligonucleotide
uuucagcauguauuacuug

SEQ ID NO: 10700 - RNA, 19 nt, Artificial Sequence
  Synthetic Oligonucleotide
uucagcauguauuacuuga

SEQ ID NO: 10701 - RNA, 19 nt, Artificial Sequence
  Synthetic Oligonucleotide
cacaauauuuucccaucug

SEQ ID NO: 10702 - RNA, 19 nt, Artificial Sequence
  Synthetic Oligonucleotide
aacacuaaggugaaaagau

SEQ ID NO: 10703 - RNA, 19 nt, Artificial Sequence
  Synthetic Oligonucleotide
aaugugaaagucaucgaca

SEQ ID NO: 10704 - RNA, 19 nt, Artificial Sequence
  Synthetic Oligonucleotide
aaaaauuuugaaaccagua

SEQ ID NO: 10705 - RNA, 19 nt, Artificial Sequence
  Synthetic Oligonucleotide
ggacuuucauccuggaaau

SEQ ID NO: 10706 - RNA, 19 nt, Artificial Sequence
  Synthetic Oligonucleotide
aauuguaagcucagguuca

SEQ ID NO: 10707 - RNA, 19 nt, Artificial Sequence
  Synthetic Oligonucleotide
uccuggaaauauauuaacu

SEQ ID NO: 10708 - RNA, 19 nt, Artificial Sequence
  Synthetic Oligonucleotide
uauuaacuguuaaaaagaa

SEQ ID NO: 10709 - RNA, 19 nt, Artificial Sequence
  Synthetic Oligonucleotide
ucccuuuuauuucauugcu

SEQ ID NO: 10710 - RNA, 19 nt, Artificial Sequence
  Synthetic Oligonucleotide
ccaaauguuuuaggaugua

SEQ ID NO: 10711 - RNA, 19 nt, Artificial Sequence
  Synthetic Oligonucleotide
guuaaaaagaaaacauuga

SEQ ID NO: 10712 - RNA, 19 nt, Artificial Sequence
  Synthetic Oligonucleotide
acugacaucauugccaauu

SEQ ID NO: 10713 - RNA, 19 nt, Artificial Sequence
  Synthetic Oligonucleotide
ugaaaccaguacuuuauca

SEQ ID NO: 10714 - RNA, 19 nt, Artificial Sequence
  Synthetic Oligonucleotide
cuauugauguucugccaga

SEQ ID NO: 10715 - RNA, 19 nt, Artificial Sequence
  Synthetic Oligonucleotide
aauauauuaacuguuaaaa

SEQ ID NO: 10716 - RNA, 19 nt, Artificial Sequence
  Synthetic Oligonucleotide
cccuuuuauuucauugcuu

SEQ ID NO: 10717 - RNA, 19 nt, Artificial Sequence
  Synthetic Oligonucleotide
cucauuguuuauuaaccug

SEQ ID NO: 10718 - RNA, 19 nt, Artificial Sequence
  Synthetic Oligonucleotide
gaugaugugcguaacagau

SEQ ID NO: 10719 - RNA, 19 nt, Artificial Sequence
  Synthetic Oligonucleotide
aauggacuuucauccugga

SEQ ID NO: 10720 - RNA, 19 nt, Artificial Sequence
  Synthetic Oligonucleotide
uuuugaaaccaguacuuua

SEQ ID NO: 10721 - RNA, 19 nt, Artificial Sequence
  Synthetic Oligonucleotide
acaacucaggaugaaaaau

SEQ ID NO: 10722 - RNA, 19 nt, Artificial Sequence
  Synthetic Oligonucleotide
cauguauuacuugacaaag

SEQ ID NO: 10723 - RNA, 19 nt, Artificial Sequence
  Synthetic Oligonucleotide
aaauuguaagcucagguuc

SEQ ID NO: 10724 - RNA, 19 nt, Artificial Sequence
  Synthetic Oligonucleotide
guuuauuaaccuguauucu

SEQ ID NO: 10725 - RNA, 19 nt, Artificial Sequence
  Synthetic Oligonucleotide
aaaccaguacuuuaucauu

SEQ ID NO: 10726 - RNA, 19 nt, Artificial Sequence
  Synthetic Oligonucleotide
gaaugugaaagucaucgac

SEQ ID NO: 10727 - RNA, 19 nt, Artificial Sequence
  Synthetic Oligonucleotide
aucaaugauuaugaacaac

SEQ ID NO: 10728 - RNA, 19 nt, Artificial Sequence
  Synthetic Oligonucleotide
uaaugaucucauuguuuau

SEQ ID NO: 10729 - RNA, 19 nt, Artificial Sequence
  Synthetic Oligonucleotide
guauucuguuuacaugucu

SEQ ID NO: 10730 - RNA, 19 nt, Artificial Sequence
  Synthetic Oligonucleotide
auauuuucccaucuguauu

SEQ ID NO: 10731 - RNA, 19 nt, Artificial Sequence
  Synthetic Oligonucleotide
agugucugaauauauccaa

SEQ ID NO: 10732 - RNA, 19 nt, Artificial Sequence
  Synthetic Oligonucleotide
acaauauuuucccaucugu

SEQ ID NO: 10733 - RNA, 19 nt, Artificial Sequence
  Synthetic Oligonucleotide
cguucuuuuccaacaaaau

SEQ ID NO: 10734 - RNA, 19 nt, Artificial Sequence
  Synthetic Oligonucleotide
gacaucauugccaauuguu

SEQ ID NO: 10735 - RNA, 19 nt, Artificial Sequence
  Synthetic Oligonucleotide
guguugguaaugccugauu

SEQ ID NO: 10736 - RNA, 19 nt, Artificial Sequence
  Synthetic Oligonucleotide
agacugacaucauugccaa

SEQ ID NO: 10737 - RNA, 19 nt, Artificial Sequence
  Synthetic Oligonucleotide
aaagauaaugaucucauug

SEQ ID NO: 10738 - RNA, 19 nt, Artificial Sequence
  Synthetic Oligonucleotide
aacucaggaugaaaaauuu

SEQ ID NO: 10739 - RNA, 19 nt, Artificial Sequence
  Synthetic Oligonucleotide
gauaauauugcagcauuuu

SEQ ID NO: 10740 - RNA, 19 nt, Artificial Sequence
  Synthetic Oligonucleotide
aaccaguacuuuaucauuu

SEQ ID NO: 10741 - RNA, 19 nt, Artificial Sequence
  Synthetic Oligonucleotide
aauauuuucccaucuguau

SEQ ID NO: 10742 - RNA, 19 nt, Artificial Sequence
  Synthetic Oligonucleotide
caguacuuuaucauuuucu

SEQ ID NO: 10743 - RNA, 19 nt, Artificial Sequence
  Synthetic Oligonucleotide
caguacuuccaaagucuau

SEQ ID NO: 10744 - RNA, 19 nt, Artificial Sequence
  Synthetic Oligonucleotide
cuaaggugaaaagauaaug

SEQ ID NO: 10745 - RNA, 19 nt, Artificial Sequence
  Synthetic Oligonucleotide
agcucagguucaaaguguu

SEQ ID NO: 10746 - RNA, 19 nt, Artificial Sequence
  Synthetic Oligonucleotide
cugagaagacugacaucau

SEQ ID NO: 10747 - RNA, 19 nt, Artificial Sequence
  Synthetic Oligonucleotide
ggugaaaagauaaugaucu

SEQ ID NO: 10748 - RNA, 19 nt, Artificial Sequence
  Synthetic Oligonucleotide
agaaugugaaagucaucga

SEQ ID NO: 10749 - RNA, 19 nt, Artificial Sequence
  Synthetic Oligonucleotide
gcauguauuacuugacaaa

SEQ ID NO: 10750 - RNA, 19 nt, Artificial Sequence
  Synthetic Oligonucleotide
cauugcuuuugacuuuuca

SEQ ID NO: 10751 - RNA, 19 nt, Artificial Sequence
  Synthetic Oligonucleotide
uaaggugaaaagauaauga

SEQ ID NO: 10752 - RNA, 19 nt, Artificial Sequence
  Synthetic Oligonucleotide
ccugauucacaacuuugag

SEQ ID NO: 10753 - RNA, 19 nt, Artificial Sequence
  Synthetic Oligonucleotide
caaucccuuuuauuucauu

SEQ ID NO: 10754 - RNA, 19 nt, Artificial Sequence
  Synthetic Oligonucleotide
uauuucauugcuuuugacu

SEQ ID NO: 10755 - RNA, 19 nt, Artificial Sequence
  Synthetic Oligonucleotide
gucuguaauuccccacuuc

SEQ ID NO: 10756 - RNA, 19 nt, Artificial Sequence
  Synthetic Oligonucleotide
ugauacuucuuugaaugua

SEQ ID NO: 10757 - RNA, 19 nt, Artificial Sequence
  Synthetic Oligonucleotide
caaugauuaugaacaacau

SEQ ID NO: 10758 - RNA, 19 nt, Artificial Sequence
  Synthetic Oligonucleotide
gugcuguauccuuuaguaa

SEQ ID NO: 10759 - RNA, 19 nt, Artificial Sequence
  Synthetic Oligonucleotide
gucguucuuuuccaacaaa

SEQ ID NO: 10760 - RNA, 19 nt, Artificial Sequence
  Synthetic Oligonucleotide
acaaaauagcaaucccuuu

SEQ ID NO: 10761 - RNA, 19 nt, Artificial Sequence
  Synthetic Oligonucleotide
ucuguaauuccccacuuca

SEQ ID NO: 10762 - RNA, 19 nt, Artificial Sequence
  Synthetic Oligonucleotide
aaagucaucgacaagacau

SEQ ID NO: 10763 - RNA, 19 nt, Artificial Sequence
  Synthetic Oligonucleotide
uuuauuaaccuguauucug

SEQ ID NO: 10764 - RNA, 19 nt, Artificial Sequence
  Synthetic Oligonucleotide
auguuacuucuuagagaga

SEQ ID NO: 10765 - RNA, 19 nt, Artificial Sequence
  Synthetic Oligonucleotide
uccaaauguuuuaggaugu

SEQ ID NO: 10766 - RNA, 19 nt, Artificial Sequence
  Synthetic Oligonucleotide
guucuuaaauuguaagcuc

SEQ ID NO: 10767 - RNA, 19 nt, Artificial Sequence
  Synthetic Oligonucleotide
caacaaaauagcaaucccu

SEQ ID NO: 10768 - RNA, 19 nt, Artificial Sequence
  Synthetic Oligonucleotide
gaacaacaugcuaaaucag

SEQ ID NO: 10769 - RNA, 19 nt, Artificial Sequence
  Synthetic Oligonucleotide
aaacacuaaggugaaaaga

SEQ ID NO: 10770 - RNA, 19 nt, Artificial Sequence
  Synthetic Oligonucleotide
ggcuaauuuguaucaauga

SEQ ID NO: 10771 - RNA, 19 nt, Artificial Sequence
  Synthetic Oligonucleotide
auagcaaucccuuuuauuu

SEQ ID NO: 10772 - RNA, 19 nt, Artificial Sequence
  Synthetic Oligonucleotide
uggacuuucauccuggaaa

SEQ ID NO: 10773 - RNA, 19 nt, Artificial Sequence
  Synthetic Oligonucleotide
gcugauaauauugcagcau

SEQ ID NO: 10774 - RNA, 19 nt, Artificial Sequence
  Synthetic Oligonucleotide
aacaaaauagcaaucccuu

SEQ ID NO: 10775 - RNA, 19 nt, Artificial Sequence
  Synthetic Oligonucleotide
auguuuuaggauguauguu

SEQ ID NO: 10776 - RNA, 19 nt, Artificial Sequence
  Synthetic Oligonucleotide
uagugucugaauauaucca

SEQ ID NO: 10777 - RNA, 19 nt, Artificial Sequence
  Synthetic Oligonucleotide
ccuuuuauuucauugcuuu

SEQ ID NO: 10778 - RNA, 19 nt, Artificial Sequence
  Synthetic Oligonucleotide
gucugaauauauccaaaug

SEQ ID NO: 10779 - RNA, 19 nt, Artificial Sequence
  Synthetic Oligonucleotide
cagaaugugaaagucaucg

SEQ ID NO: 10780 - RNA, 19 nt, Artificial Sequence
  Synthetic Oligonucleotide
aaaauuuugaaaccaguac

SEQ ID NO: 10781 - RNA, 19 nt, Artificial Sequence
  Synthetic Oligonucleotide
uuuucagcauguauuacuu

SEQ ID NO: 10782 - RNA, 19 nt, Artificial Sequence
  Synthetic Oligonucleotide
ucugaauauauccaaaugu

SEQ ID NO: 10783 - RNA, 19 nt, Artificial Sequence
  Synthetic Oligonucleotide
augaaaaauuuugaaacca

SEQ ID NO: 10784 - RNA, 19 nt, Artificial Sequence
  Synthetic Oligonucleotide
aggaugaaaaauuuugaaa

SEQ ID NO: 10785 - RNA, 19 nt, Artificial Sequence
  Synthetic Oligonucleotide
caaagucuauauaugacua

SEQ ID NO: 10786 - RNA, 19 nt, Artificial Sequence
  Synthetic Oligonucleotide
gugucugaauauauccaaa

SEQ ID NO: 10787 - RNA, 19 nt, Artificial Sequence
  Synthetic Oligonucleotide
augauuaugaacaacaugc

SEQ ID NO: 10788 - RNA, 19 nt, Artificial Sequence
  Synthetic Oligonucleotide
uuaaaaagaaaacauugaa

SEQ ID NO: 10789 - RNA, 19 nt, Artificial Sequence
  Synthetic Oligonucleotide
ugaaaagauaaugaucuca

SEQ ID NO: 10790 - RNA, 19 nt, Artificial Sequence
  Synthetic Oligonucleotide
ucguucuuuuccaacaaaa

SEQ ID NO: 10791 - RNA, 19 nt, Artificial Sequence
  Synthetic Oligonucleotide
ugcuguauccuuuaguaaa

SEQ ID NO: 10792 - RNA, 19 nt, Artificial Sequence
  Synthetic Oligonucleotide
agugcuguauccuuuagua

SEQ ID NO: 10793 - RNA, 19 nt, Artificial Sequence
  Synthetic Oligonucleotide
aagucuauauaugacuauu

SEQ ID NO: 10794 - RNA, 19 nt, Artificial Sequence
  Synthetic Oligonucleotide
caaaguguugguaaugccu

SEQ ID NO: 10795 - RNA, 19 nt, Artificial Sequence
  Synthetic Oligonucleotide
gguaauuggugauacuucu

SEQ ID NO: 10796 - RNA, 19 nt, Artificial Sequence
  Synthetic Oligonucleotide
caaauguuuuaggauguau

SEQ ID NO: 10797 - RNA, 19 nt, Artificial Sequence
  Synthetic Oligonucleotide
auacuucuuugaauguaga

SEQ ID NO: 10798 - RNA, 19 nt, Artificial Sequence
  Synthetic Oligonucleotide
gaucucauuguuuauuaac

SEQ ID NO: 10799 - RNA, 19 nt, Artificial Sequence
  Synthetic Oligonucleotide
aaauguuuuaggauguaug

SEQ ID NO: 10800 - RNA, 19 nt, Artificial Sequence
  Synthetic Oligonucleotide
gagaagacugacaucauug

SEQ ID NO: 10801 - RNA, 19 nt, Artificial Sequence
  Synthetic Oligonucleotide
acuguuaaaaagaaaacau

SEQ ID NO: 10802 - RNA, 19 nt, Artificial Sequence
  Synthetic Oligonucleotide
uauugauguucugccagaa

SEQ ID NO: 10803 - RNA, 19 nt, Artificial Sequence
  Synthetic Oligonucleotide
aacagugguucuuaaauug

SEQ ID NO: 10804 - RNA, 19 nt, Artificial Sequence
  Synthetic Oligonucleotide
uuucauccuggaaauauau

SEQ ID NO: 10805 - RNA, 19 nt, Artificial Sequence
  Synthetic Oligonucleotide
cuuuggcugauaauauugc

SEQ ID NO: 10806 - RNA, 19 nt, Artificial Sequence
  Synthetic Oligonucleotide
aucauuuucuccugaggaa

SEQ ID NO: 10807 - RNA, 19 nt, Artificial Sequence
  Synthetic Oligonucleotide
aucaguacuuccaaagucu

SEQ ID NO: 10808 - RNA, 19 nt, Artificial Sequence
  Synthetic Oligonucleotide
uuuuauuucauugcuuuug

SEQ ID NO: 10809 - RNA, 19 nt, Artificial Sequence
  Synthetic Oligonucleotide
aaauggacuuucauccugg

SEQ ID NO: 10810 - RNA, 19 nt, Artificial Sequence
  Synthetic Oligonucleotide
cuuccaaagucuauauaug

SEQ ID NO: 10811 - RNA, 19 nt, Artificial Sequence
  Synthetic Oligonucleotide
ggugucguucuuuuccaac

SEQ ID NO: 10812 - RNA, 19 nt, Artificial Sequence
  Synthetic Oligonucleotide
aggugaaaagauaaugauc

SEQ ID NO: 10813 - RNA, 19 nt, Artificial Sequence
  Synthetic Oligonucleotide
uauuacuugacaaagagac

SEQ ID NO: 10814 - RNA, 19 nt, Artificial Sequence
  Synthetic Oligonucleotide
gaugugcguaacagauuca

SEQ ID NO: 10815 - RNA, 19 nt, Artificial Sequence
  Synthetic Oligonucleotide
ugaaaaauuuugaaaccag

SEQ ID NO: 10816 - RNA, 19 nt, Artificial Sequence
  Synthetic Oligonucleotide
ugauaauauugcagcauuu

SEQ ID NO: 10817 - RNA, 19 nt, Artificial Sequence
  Synthetic Oligonucleotide
uggaugaugugcguaacag

SEQ ID NO: 10818 - RNA, 19 nt, Artificial Sequence
  Synthetic Oligonucleotide
cgacaagacauuggugagg

SEQ ID NO: 10819 - RNA, 19 nt, Artificial Sequence
  Synthetic Oligonucleotide
aaguguugguaaugccuga

SEQ ID NO: 10820 - RNA, 19 nt, Artificial Sequence
  Synthetic Oligonucleotide
aauggcugagaagacugac

SEQ ID NO: 10821 - RNA, 19 nt, Artificial Sequence
  Synthetic Oligonucleotide
gaagaaacuuuggcugaua

SEQ ID NO: 10822 - RNA, 19 nt, Artificial Sequence
  Synthetic Oligonucleotide
aaaagauaaugaucucauu

SEQ ID NO: 10823 - RNA, 19 nt, Artificial Sequence
  Synthetic Oligonucleotide
uguaucaaugauuaugaac

SEQ ID NO: 10824 - RNA, 19 nt, Artificial Sequence
  Synthetic Oligonucleotide
gacugacaucauugccaau

SEQ ID NO: 10825 - RNA, 19 nt, Artificial Sequence
  Synthetic Oligonucleotide
agcaaacacuaaggugaaa

SEQ ID NO: 10826 - RNA, 19 nt, Artificial Sequence
  Synthetic Oligonucleotide
ugccagaaugugaaaguca

SEQ ID NO: 10827 - RNA, 19 nt, Artificial Sequence
  Synthetic Oligonucleotide
ccacuauugauguucugcc

SEQ ID NO: 10828 - RNA, 19 nt, Artificial Sequence
  Synthetic Oligonucleotide
uuugaaaccaguacuuuau

SEQ ID NO: 10829 - RNA, 19 nt, Artificial Sequence
  Synthetic Oligonucleotide
uguaauuccccacuucaau

SEQ ID NO: 10830 - RNA, 19 nt, Artificial Sequence
  Synthetic Oligonucleotide
uagcaauaaccugugaaaa

SEQ ID NO: 10831 - RNA, 19 nt, Artificial Sequence
  Synthetic Oligonucleotide
aacuguuaaaaagaaaaca

SEQ ID NO: 10832 - RNA, 19 nt, Artificial Sequence
  Synthetic Oligonucleotide
cacaacucaggaugaaaaa

SEQ ID NO: 10833 - RNA, 19 nt, Artificial Sequence
  Synthetic Oligonucleotide
agguucaaaguguugguaa

SEQ ID NO: 10834 - RNA, 19 nt, Artificial Sequence
  Synthetic Oligonucleotide
aaccuguauucuguuuaca

SEQ ID NO: 10835 - RNA, 19 nt, Artificial Sequence
  Synthetic Oligonucleotide
aucacaucuuuagugucug

SEQ ID NO: 10836 - RNA, 19 nt, Artificial Sequence
  Synthetic Oligonucleotide
guaagcucagguucaaagu

SEQ ID NO: 10837 - RNA, 19 nt, Artificial Sequence
  Synthetic Oligonucleotide
cuuugaauguagauuucca

SEQ ID NO: 10838 - RNA, 19 nt, Artificial Sequence
  Synthetic Oligonucleotide
ggaauguugcugaaacaga

SEQ ID NO: 10839 - RNA, 19 nt, Artificial Sequence
  Synthetic Oligonucleotide
uaacuguuaaaaagaaaac

SEQ ID NO: 10840 - RNA, 19 nt, Artificial Sequence
  Synthetic Oligonucleotide
auauauuaacuguuaaaaa

SEQ ID NO: 10841 - RNA, 19 nt, Artificial Sequence
  Synthetic Oligonucleotide
aauguuuuaggauguaugu

SEQ ID NO: 10842 - RNA, 19 nt, Artificial Sequence
  Synthetic Oligonucleotide
uuguaucaaugauuaugaa

SEQ ID NO: 10843 - RNA, 19 nt, Artificial Sequence
  Synthetic Oligonucleotide
uaaaacagugguucuuaaa

SEQ ID NO: 10844 - RNA, 19 nt, Artificial Sequence
  Synthetic Oligonucleotide
agaaacuuuggcugauaau

SEQ ID NO: 10845 - RNA, 19 nt, Artificial Sequence
  Synthetic Oligonucleotide
aagaucugacagugcacaa

SEQ ID NO: 10846 - RNA, 19 nt, Artificial Sequence
  Synthetic Oligonucleotide
aaggugaaaagauaaugau

SEQ ID NO: 10847 - RNA, 19 nt, Artificial Sequence
  Synthetic Oligonucleotide
auauugcagcauuuuccag

SEQ ID NO: 10848 - RNA, 19 nt, Artificial Sequence
  Synthetic Oligonucleotide
uagcaaacacuaaggugaa

SEQ ID NO: 10849 - RNA, 19 nt, Artificial Sequence
  Synthetic Oligonucleotide
gguaaugccugauucacaa

SEQ ID NO: 10850 - RNA, 19 nt, Artificial Sequence
  Synthetic Oligonucleotide
ugugaaagucaucgacaag

SEQ ID NO: 10851 - RNA, 19 nt, Artificial Sequence
  Synthetic Oligonucleotide
aaaacagugguucuuaaau

SEQ ID NO: 10852 - RNA, 19 nt, Artificial Sequence
  Synthetic Oligonucleotide
uguauucuguuuacauguc

SEQ ID NO: 10853 - RNA, 19 nt, Artificial Sequence
  Synthetic Oligonucleotide
agaagacugacaucauugc

SEQ ID NO: 10854 - RNA, 19 nt, Artificial Sequence
  Synthetic Oligonucleotide
uuaaauuguaagcucaggu

SEQ ID NO: 10855 - RNA, 19 nt, Artificial Sequence
  Synthetic Oligonucleotide
gcaaacacuaaggugaaaa

SEQ ID NO: 10856 - RNA, 19 nt, Artificial Sequence
  Synthetic Oligonucleotide
cagguucaaaguguuggua

SEQ ID NO: 10857 - RNA, 19 nt, Artificial Sequence
  Synthetic Oligonucleotide
caagacauuggugaggaaa

SEQ ID NO: 10858 - RNA, 19 nt, Artificial Sequence
  Synthetic Oligonucleotide
guagcaaacacuaagguga

SEQ ID NO: 10859 - RNA, 19 nt, Artificial Sequence
  Synthetic Oligonucleotide
aaacagugguucuuaaauu

SEQ ID NO: 10860 - RNA, 19 nt, Artificial Sequence
  Synthetic Oligonucleotide
ucaaaguguugguaaugcc

SEQ ID NO: 10861 - RNA, 19 nt, Artificial Sequence
  Synthetic Oligonucleotide
uuaaccuguauucuguuua

SEQ ID NO: 10862 - RNA, 19 nt, Artificial Sequence
  Synthetic Oligonucleotide
guugguaaugccugauuca

SEQ ID NO: 10863 - RNA, 19 nt, Artificial Sequence
  Synthetic Oligonucleotide
aguacuuccaaagucuaua

SEQ ID NO: 10864 - RNA, 19 nt, Artificial Sequence
  Synthetic Oligonucleotide
guacuuccaaagucuauau

SEQ ID NO: 10865 - RNA, 19 nt, Artificial Sequence
  Synthetic Oligonucleotide
aaugauuaugaacaacaug

SEQ ID NO: 10866 - RNA, 19 nt, Artificial Sequence
  Synthetic Oligonucleotide
uucaagauguccucgagau

SEQ ID NO: 10867 - RNA, 19 nt, Artificial Sequence
  Synthetic Oligonucleotide
uuaaaacagugguucuuaa

SEQ ID NO: 10868 - RNA, 19 nt, Artificial Sequence
  Synthetic Oligonucleotide
ucucauuguuuauuaaccu

SEQ ID NO: 10869 - RNA, 19 nt, Artificial Sequence
  Synthetic Oligonucleotide
uguugguaaugccugauuc

SEQ ID NO: 10870 - RNA, 19 nt, Artificial Sequence
  Synthetic Oligonucleotide
aacaugcuaaaucaguacu

SEQ ID NO: 10871 - RNA, 19 nt, Artificial Sequence
  Synthetic Oligonucleotide
cuuaaauuguaagcucagg

SEQ ID NO: 10872 - RNA, 19 nt, Artificial Sequence
  Synthetic Oligonucleotide
cguuggcugcaacuguaua

SEQ ID NO: 10873 - RNA, 19 nt, Artificial Sequence
  Synthetic Oligonucleotide
aaucaguacuuccaaaguc

SEQ ID NO: 10874 - RNA, 19 nt, Artificial Sequence
  Synthetic Oligonucleotide
aagacauuggugaggaaaa

SEQ ID NO: 10875 - RNA, 19 nt, Artificial Sequence
  Synthetic Oligonucleotide
auguauuacuugacaaaga

SEQ ID NO: 10876 - RNA, 19 nt, Artificial Sequence
  Synthetic Oligonucleotide
gauacuucuuugaauguag

SEQ ID NO: 10877 - RNA, 19 nt, Artificial Sequence
  Synthetic Oligonucleotide
agaucugacagugcacaau

SEQ ID NO: 10878 - RNA, 19 nt, Artificial Sequence
  Synthetic Oligonucleotide
aucuuuagugucugaauau

SEQ ID NO: 10879 - RNA, 19 nt, Artificial Sequence
  Synthetic Oligonucleotide
caaacacuaaggugaaaag

SEQ ID NO: 10880 - RNA, 19 nt, Artificial Sequence
  Synthetic Oligonucleotide
agcaauaaccugugaaaau

SEQ ID NO: 10881 - RNA, 19 nt, Artificial Sequence
  Synthetic Oligonucleotide
uauauuaacuguuaaaaag

SEQ ID NO: 10882 - RNA, 19 nt, Artificial Sequence
  Synthetic Oligonucleotide
augugcguaacagauucaa

SEQ ID NO: 10883 - RNA, 19 nt, Artificial Sequence
  Synthetic Oligonucleotide
ucaguacuuccaaagucua

SEQ ID NO: 10884 - RNA, 19 nt, Artificial Sequence
  Synthetic Oligonucleotide
uaauuggugauacuucuuu

SEQ ID NO: 10885 - RNA, 19 nt, Artificial Sequence
  Synthetic Oligonucleotide
ccaacaaaauagcaauccc

SEQ ID NO: 10886 - RNA, 19 nt, Artificial Sequence
  Synthetic Oligonucleotide
uaagcucagguucaaagug

SEQ ID NO: 10887 - RNA, 19 nt, Artificial Sequence
  Synthetic Oligonucleotide
cugacagugcacaauauuu

SEQ ID NO: 10888 - RNA, 19 nt, Artificial Sequence
  Synthetic Oligonucleotide
gcagcauuuuccagaugga

SEQ ID NO: 10889 - RNA, 19 nt, Artificial Sequence
  Synthetic Oligonucleotide
gguucuuaaauuguaagcu

SEQ ID NO: 10890 - RNA, 19 nt, Artificial Sequence
  Synthetic Oligonucleotide
augaagaaacuuuggcuga

SEQ ID NO: 10891 - RNA, 19 nt, Artificial Sequence
  Synthetic Oligonucleotide
acacuaaggugaaaagaua

SEQ ID NO: 10892 - RNA, 19 nt, Artificial Sequence
  Synthetic Oligonucleotide
uguuuauuaaccuguauuc

SEQ ID NO: 10893 - RNA, 19 nt, Artificial Sequence
  Synthetic Oligonucleotide
ccacaacucaggaugaaaa

SEQ ID NO: 10894 - RNA, 19 nt, Artificial Sequence
  Synthetic Oligonucleotide
aaacuuuggcugauaauau

SEQ ID NO: 10895 - RNA, 19 nt, Artificial Sequence
  Synthetic Oligonucleotide
gcacaauauuuucccaucu

SEQ ID NO: 10896 - RNA, 19 nt, Artificial Sequence
  Synthetic Oligonucleotide
gaaagucaucgacaagaca

SEQ ID NO: 10897 - RNA, 19 nt, Artificial Sequence
  Synthetic Oligonucleotide
uuaugaacaacaugcuaaa

SEQ ID NO: 10898 - RNA, 19 nt, Artificial Sequence
  Synthetic Oligonucleotide
cuguauucuguuuacaugu

SEQ ID NO: 10899 - RNA, 19 nt, Artificial Sequence
  Synthetic Oligonucleotide
auaauauugcagcauuuuc

SEQ ID NO: 10900 - RNA, 19 nt, Artificial Sequence
  Synthetic Oligonucleotide
auuuucccaucuguauuau

SEQ ID NO: 10901 - RNA, 19 nt, Artificial Sequence
  Synthetic Oligonucleotide
uauguuacuucuuagagag

SEQ ID NO: 10902 - RNA, 19 nt, Artificial Sequence
  Synthetic Oligonucleotide
aucgacaagacauugguga

SEQ ID NO: 10903 - RNA, 19 nt, Artificial Sequence
  Synthetic Oligonucleotide
cucagguucaaaguguugg

SEQ ID NO: 10904 - RNA, 19 nt, Artificial Sequence
  Synthetic Oligonucleotide
guauuacuugacaaagaga

SEQ ID NO: 10905 - RNA, 19 nt, Artificial Sequence
  Synthetic Oligonucleotide
uguauuacuugacaaagag

SEQ ID NO: 10906 - RNA, 19 nt, Artificial Sequence
  Synthetic Oligonucleotide
ugucguucuuuuccaacaa

SEQ ID NO: 10907 - RNA, 19 nt, Artificial Sequence
  Synthetic Oligonucleotide
aaagucuauauaugacuau

SEQ ID NO: 10908 - RNA, 19 nt, Artificial Sequence
  Synthetic Oligonucleotide
gguagcaaacacuaaggug

SEQ ID NO: 10909 - RNA, 19 nt, Artificial Sequence
  Synthetic Oligonucleotide
aucaaauggcugagaagac

SEQ ID NO: 10910 - RNA, 19 nt, Artificial Sequence
  Synthetic Oligonucleotide
accaguacuuuaucauuuu

SEQ ID NO: 10911 - RNA, 19 nt, Artificial Sequence
  Synthetic Oligonucleotide
uaaugccugauucacaacu

SEQ ID NO: 10912 - RNA, 19 nt, Artificial Sequence
  Synthetic Oligonucleotide
acuauugauguucugccag

SEQ ID NO: 10913 - RNA, 19 nt, Artificial Sequence
  Synthetic Oligonucleotide
uuauuaaccuguauucugu

SEQ ID NO: 10914 - RNA, 19 nt, Artificial Sequence
  Synthetic Oligonucleotide
auugauguucugccagaaa

SEQ ID NO: 10915 - RNA, 19 nt, Artificial Sequence
  Synthetic Oligonucleotide
ggaugaaaaauuuugaaac

SEQ ID NO: 10916 - RNA, 19 nt, Artificial Sequence
  Synthetic Oligonucleotide
ucauuuucuccugaggaaa

SEQ ID NO: 10917 - RNA, 19 nt, Artificial Sequence
  Synthetic Oligonucleotide
guaaugccugauucacaac

SEQ ID NO: 10918 - RNA, 19 nt, Artificial Sequence
  Synthetic Oligonucleotide
ccuguauucuguuuacaug

SEQ ID NO: 10919 - RNA, 19 nt, Artificial Sequence
  Synthetic Oligonucleotide
gucaucgacaagacauugg

SEQ ID NO: 10920 - RNA, 19 nt, Artificial Sequence
  Synthetic Oligonucleotide
aagaaacuuuggcugauaa

SEQ ID NO: 10921 - RNA, 19 nt, Artificial Sequence
  Synthetic Oligonucleotide
agugguucuuaaauuguaa

SEQ ID NO: 10922 - RNA, 19 nt, Artificial Sequence
  Synthetic Oligonucleotide
uauauccaaauguuuuagg

SEQ ID NO: 10923 - RNA, 19 nt, Artificial Sequence
  Synthetic Oligonucleotide
agacauuggugaggaaaaa

SEQ ID NO: 10924 - RNA, 19 nt, Artificial Sequence
  Synthetic Oligonucleotide
ugacagugcacaauauuuu

SEQ ID NO: 10925 - RNA, 19 nt, Artificial Sequence
  Synthetic Oligonucleotide
gccagaaugugaaagucau

SEQ ID NO: 10926 - RNA, 19 nt, Artificial Sequence
  Synthetic Oligonucleotide
aauguagauuuccaaucac

SEQ ID NO: 10927 - RNA, 19 nt, Artificial Sequence
  Synthetic Oligonucleotide
uguuaaaaagaaaacauug

SEQ ID NO: 10928 - RNA, 19 nt, Artificial Sequence
  Synthetic Oligonucleotide
ugaacaacaugcuaaauca

SEQ ID NO: 10929 - RNA, 19 nt, Artificial Sequence
  Synthetic Oligonucleotide
uaucaaugauuaugaacaa

SEQ ID NO: 10930 - RNA, 19 nt, Artificial Sequence
  Synthetic Oligonucleotide
auucuguuuacaugucuuu

SEQ ID NO: 10931 - RNA, 19 nt, Artificial Sequence
  Synthetic Oligonucleotide
acucaggaugaaaaauuuu

SEQ ID NO: 10932 - RNA, 19 nt, Artificial Sequence
  Synthetic Oligonucleotide
auccaaauguuuuaggaug

SEQ ID NO: 10933 - RNA, 19 nt, Artificial Sequence
  Synthetic Oligonucleotide
cgguaauuggugauacuuc

SEQ ID NO: 10934 - RNA, 19 nt, Artificial Sequence
  Synthetic Oligonucleotide
ugaagaaacuuuggcugau

SEQ ID NO: 10935 - RNA, 19 nt, Artificial Sequence
  Synthetic Oligonucleotide
ucauugcuuuugacuuuuc

SEQ ID NO: 10936 - RNA, 19 nt, Artificial Sequence
  Synthetic Oligonucleotide
ugucugaauauauccaaau

SEQ ID NO: 10937 - RNA, 19 nt, Artificial Sequence
  Synthetic Oligonucleotide
uuguuuauuaaccuguauu

SEQ ID NO: 10938 - RNA, 19 nt, Artificial Sequence
  Synthetic Oligonucleotide
auauccaaauguuuuagga

SEQ ID NO: 10939 - RNA, 19 nt, Artificial Sequence
  Synthetic Oligonucleotide
cagugcacaauauuuuccc

SEQ ID NO: 10940 - RNA, 19 nt, Artificial Sequence
  Synthetic Oligonucleotide
accuguauucuguuuacau

SEQ ID NO: 10941 - RNA, 19 nt, Artificial Sequence
  Synthetic Oligonucleotide
augccugauucacaacuuu

SEQ ID NO: 10942 - RNA, 19 nt, Artificial Sequence
  Synthetic Oligonucleotide
uugauguucugccagaaau

SEQ ID NO: 10943 - RNA, 19 nt, Artificial Sequence
  Synthetic Oligonucleotide
gaauguagauuuccaauca

SEQ ID NO: 10944 - RNA, 19 nt, Artificial Sequence
  Synthetic Oligonucleotide
cuuuuauuucauugcuuuu

SEQ ID NO: 10945 - RNA, 19 nt, Artificial Sequence
  Synthetic Oligonucleotide
ccagaaugugaaagucauc

SEQ ID NO: 10946 - RNA, 19 nt, Artificial Sequence
  Synthetic Oligonucleotide
augugaaagucaucgacaa

SEQ ID NO: 10947 - RNA, 19 nt, Artificial Sequence
  Synthetic Oligonucleotide
augaugugcguaacagauu

SEQ ID NO: 10948 - RNA, 19 nt, Artificial Sequence
  Synthetic Oligonucleotide
gcucagguucaaaguguug

SEQ ID NO: 10949 - RNA, 19 nt, Artificial Sequence
  Synthetic Oligonucleotide
uucuguuuacaugucuuua

SEQ ID NO: 10950 - RNA, 19 nt, Artificial Sequence
  Synthetic Oligonucleotide
acaagacauuggugaggaa

SEQ ID NO: 10951 - RNA, 19 nt, Artificial Sequence
  Synthetic Oligonucleotide
guaaaauuggagguagcaa

SEQ ID NO: 10952 - RNA, 19 nt, Artificial Sequence
  Synthetic Oligonucleotide
uacuuccaaagucuauaua

SEQ ID NO: 10953 - RNA, 19 nt, Artificial Sequence
  Synthetic Oligonucleotide
auguagauuuccaaucaca

SEQ ID NO: 10954 - RNA, 19 nt, Artificial Sequence
  Synthetic Oligonucleotide
caagaucugacagugcaca

SEQ ID NO: 10955 - RNA, 19 nt, Artificial Sequence
  Synthetic Oligonucleotide
acuucuuugaauguagauu

SEQ ID NO: 10956 - RNA, 19 nt, Artificial Sequence
  Synthetic Oligonucleotide
cugauaauauugcagcauu

SEQ ID NO: 10957 - RNA, 19 nt, Artificial Sequence
  Synthetic Oligonucleotide
gcuaaaucaguacuuccaa

SEQ ID NO: 10958 - RNA, 19 nt, Artificial Sequence
  Synthetic Oligonucleotide
gagagaaauaaagcauuuu

SEQ ID NO: 10959 - RNA, 19 nt, Artificial Sequence
  Synthetic Oligonucleotide
auauauccaaauguuuuag

SEQ ID NO: 10960 - RNA, 19 nt, Artificial Sequence
  Synthetic Oligonucleotide
uuauuucauugcuuuugac

SEQ ID NO: 10961 - RNA, 19 nt, Artificial Sequence
  Synthetic Oligonucleotide
agugcacaauauuuuccca

SEQ ID NO: 10962 - RNA, 19 nt, Artificial Sequence
  Synthetic Oligonucleotide
cacaucuuuagugucugaa

SEQ ID NO: 10963 - RNA, 19 nt, Artificial Sequence
  Synthetic Oligonucleotide
guauguuacuucuuagaga

SEQ ID NO: 10964 - RNA, 19 nt, Artificial Sequence
  Synthetic Oligonucleotide
aggaaccuuuuagaaagaa

SEQ ID NO: 10965 - RNA, 19 nt, Artificial Sequence
  Synthetic Oligonucleotide
guucaagauguccucgaga

SEQ ID NO: 10966 - RNA, 19 nt, Artificial Sequence
  Synthetic Oligonucleotide
cggcuaauuuguaucaaug

SEQ ID NO: 10967 - RNA, 19 nt, Artificial Sequence
  Synthetic Oligonucleotide
agggugucguucuuuucca

SEQ ID NO: 10968 - RNA, 19 nt, Artificial Sequence
  Synthetic Oligonucleotide
ccuuuuagaaagaaaugga

SEQ ID NO: 10969 - RNA, 19 nt, Artificial Sequence
  Synthetic Oligonucleotide
auugcuuuugacuuuucaa

SEQ ID NO: 10970 - RNA, 19 nt, Artificial Sequence
  Synthetic Oligonucleotide
caaauggcugagaagacug

SEQ ID NO: 10971 - RNA, 19 nt, Artificial Sequence
  Synthetic Oligonucleotide
guucuuuuccaacaaaaua

SEQ ID NO: 10972 - RNA, 19 nt, Artificial Sequence
  Synthetic Oligonucleotide
gugucguucuuuuccaaca

SEQ ID NO: 10973 - RNA, 19 nt, Artificial Sequence
  Synthetic Oligonucleotide
uauuaaccuguauucuguu

SEQ ID NO: 10974 - RNA, 19 nt, Artificial Sequence
  Synthetic Oligonucleotide
uaaauuguaagcucagguu

SEQ ID NO: 10975 - RNA, 19 nt, Artificial Sequence
  Synthetic Oligonucleotide
gcugagaagacugacauca

SEQ ID NO: 10976 - RNA, 19 nt, Artificial Sequence
  Synthetic Oligonucleotide
cggaauguugcugaaacag

SEQ ID NO: 10977 - RNA, 19 nt, Artificial Sequence
  Synthetic Oligonucleotide
aauauauccaaauguuuua

SEQ ID NO: 10978 - RNA, 19 nt, Artificial Sequence
  Synthetic Oligonucleotide
cagucuguaauuccccacu

SEQ ID NO: 10979 - RNA, 19 nt, Artificial Sequence
  Synthetic Oligonucleotide
ggcugcaacuguauaucua

SEQ ID NO: 10980 - RNA, 19 nt, Artificial Sequence
  Synthetic Oligonucleotide
uuaacuguuaaaaagaaaa

SEQ ID NO: 10981 - RNA, 19 nt, Artificial Sequence
  Synthetic Oligonucleotide
gaugaagaaacuuuggcug

SEQ ID NO: 10982 - RNA, 19 nt, Artificial Sequence
  Synthetic Oligonucleotide
caacaugcuaaaucaguac

SEQ ID NO: 10983 - RNA, 19 nt, Artificial Sequence
  Synthetic Oligonucleotide
uggugauacuucuuugaau

SEQ ID NO: 10984 - RNA, 19 nt, Artificial Sequence
  Synthetic Oligonucleotide
auucacaacuuugagaagg

SEQ ID NO: 10985 - RNA, 19 nt, Artificial Sequence
  Synthetic Oligonucleotide
uucauugcuuuugacuuuu

SEQ ID NO: 10986 - RNA, 19 nt, Artificial Sequence
  Synthetic Oligonucleotide
uuuuccagauggaagcugu

SEQ ID NO: 10987 - RNA, 19 nt, Artificial Sequence
  Synthetic Oligonucleotide
uauucuguuuacaugucuu

SEQ ID NO: 10988 - RNA, 19 nt, Artificial Sequence
  Synthetic Oligonucleotide
cuugacaaagagacacugu

SEQ ID NO: 10989 - RNA, 19 nt, Artificial Sequence
  Synthetic Oligonucleotide
guucaaaguguugguaaug

SEQ ID NO: 10990 - RNA, 19 nt, Artificial Sequence
  Synthetic Oligonucleotide
cuguuaaaaagaaaacauu

SEQ ID NO: 10991 - RNA, 19 nt, Artificial Sequence
  Synthetic Oligonucleotide
auacaaagggugucguucu

SEQ ID NO: 10992 - RNA, 19 nt, Artificial Sequence
  Synthetic Oligonucleotide
cuuuaucauuuucuccuga

SEQ ID NO: 10993 - RNA, 19 nt, Artificial Sequence
  Synthetic Oligonucleotide
uuuaaaacagugguucuua

SEQ ID NO: 10994 - RNA, 19 nt, Artificial Sequence
  Synthetic Oligonucleotide
caaucacaucuuuaguguc

SEQ ID NO: 10995 - RNA, 19 nt, Artificial Sequence
  Synthetic Oligonucleotide
uccaaagucuauauaugac

SEQ ID NO: 10996 - RNA, 19 nt, Artificial Sequence
  Synthetic Oligonucleotide
uaucauuuucuccugagga

SEQ ID NO: 10997 - RNA, 19 nt, Artificial Sequence
  Synthetic Oligonucleotide
uguuacuucuuagagagaa

SEQ ID NO: 10998 - RNA, 19 nt, Artificial Sequence
  Synthetic Oligonucleotide
guacuuuaucauuuucucc

SEQ ID NO: 10999 - RNA, 19 nt, Artificial Sequence
  Synthetic Oligonucleotide
ucugacagugcacaauauu

SEQ ID NO: 11000 - RNA, 19 nt, Artificial Sequence
  Synthetic Oligonucleotide
aagauguccucgagauacu

SEQ ID NO: 11001 - RNA, 19 nt, Artificial Sequence
  Synthetic Oligonucleotide
acuugacaaagagacacug

SEQ ID NO: 11002 - RNA, 19 nt, Artificial Sequence
  Synthetic Oligonucleotide
ugccugauucacaacuuug

SEQ ID NO: 11003 - RNA, 19 nt, Artificial Sequence
  Synthetic Oligonucleotide
uaugaacaacaugcuaaau

SEQ ID NO: 11004 - RNA, 19 nt, Artificial Sequence
  Synthetic Oligonucleotide
uuguaagcucagguucaaa

SEQ ID NO: 11005 - RNA, 19 nt, Artificial Sequence
  Synthetic Oligonucleotide
gaaauggacuuucauccug

SEQ ID NO: 11006 - RNA, 19 nt, Artificial Sequence
  Synthetic Oligonucleotide
aaagugcuguauccuuuag

SEQ ID NO: 11007 - RNA, 19 nt, Artificial Sequence
  Synthetic Oligonucleotide
agugggugccagaauguga

SEQ ID NO: 11008 - RNA, 19 nt, Artificial Sequence
  Synthetic Oligonucleotide
gauguauguuacuucuuag

SEQ ID NO: 11009 - RNA, 19 nt, Artificial Sequence
  Synthetic Oligonucleotide
gugaaagucaucgacaaga

SEQ ID NO: 11010 - RNA, 19 nt, Artificial Sequence
  Synthetic Oligonucleotide
agauaucaaauggcugaga

SEQ ID NO: 11011 - RNA, 19 nt, Artificial Sequence
  Synthetic Oligonucleotide
ucuguuuacaugucuuuaa

SEQ ID NO: 11012 - RNA, 19 nt, Artificial Sequence
  Synthetic Oligonucleotide
cacuaaggugaaaagauaa

SEQ ID NO: 11013 - RNA, 19 nt, Artificial Sequence
  Synthetic Oligonucleotide
gucuauauaugacuauuac

SEQ ID NO: 11014 - RNA, 19 nt, Artificial Sequence
  Synthetic Oligonucleotide
acuuuaucauuuucuccug

SEQ ID NO: 11015 - RNA, 19 nt, Artificial Sequence
  Synthetic Oligonucleotide
cagcauuuuccagauggaa

SEQ ID NO: 11016 - RNA, 19 nt, Artificial Sequence
  Synthetic Oligonucleotide
ucuuuagugucugaauaua

SEQ ID NO: 11017 - RNA, 19 nt, Artificial Sequence
  Synthetic Oligonucleotide
gugccagaaugugaaaguc

SEQ ID NO: 11018 - RNA, 19 nt, Artificial Sequence
  Synthetic Oligonucleotide
uguauguuacuucuuagag

SEQ ID NO: 11019 - RNA, 19 nt, Artificial Sequence
  Synthetic Oligonucleotide
auggcugagaagacugaca

SEQ ID NO: 11020 - RNA, 19 nt, Artificial Sequence
  Synthetic Oligonucleotide
caucuuuagugucugaaua

SEQ ID NO: 11021 - RNA, 19 nt, Artificial Sequence
  Synthetic Oligonucleotide
gaaacuuuggcugauaaua

SEQ ID NO: 11022 - RNA, 19 nt, Artificial Sequence
  Synthetic Oligonucleotide
agauguccucgagauacua

SEQ ID NO: 11023 - RNA, 19 nt, Artificial Sequence
  Synthetic Oligonucleotide
caucgacaagacauuggug

SEQ ID NO: 11024 - RNA, 19 nt, Artificial Sequence
  Synthetic Oligonucleotide
gaucugacagugcacaaua

SEQ ID NO: 11025 - RNA, 19 nt, Artificial Sequence
  Synthetic Oligonucleotide
gccugauucacaacuuuga

SEQ ID NO: 11026 - RNA, 19 nt, Artificial Sequence
  Synthetic Oligonucleotide
cugcauauguggcuaaagc

SEQ ID NO: 11027 - RNA, 19 nt, Artificial Sequence
  Synthetic Oligonucleotide
ggaaccuuuuagaaagaaa

SEQ ID NO: 11028 - RNA, 19 nt, Artificial Sequence
  Synthetic Oligonucleotide
uucaaaguguugguaaugc

SEQ ID NO: 11029 - RNA, 19 nt, Artificial Sequence
  Synthetic Oligonucleotide
gcuguauccuuuaguaaaa

SEQ ID NO: 11030 - RNA, 19 nt, Artificial Sequence
  Synthetic Oligonucleotide
gccacaacucaggaugaaa

SEQ ID NO: 11031 - RNA, 19 nt, Artificial Sequence
  Synthetic Oligonucleotide
acaucuuuagugucugaau

SEQ ID NO: 11032 - RNA, 19 nt, Artificial Sequence
  Synthetic Oligonucleotide
gguucaaaguguugguaau

SEQ ID NO: 11033 - RNA, 19 nt, Artificial Sequence
  Synthetic Oligonucleotide
auuuucuccugaggaaaau

SEQ ID NO: 11034 - RNA, 19 nt, Artificial Sequence
  Synthetic Oligonucleotide
guuggcugcaacuguauau

SEQ ID NO: 11035 - RNA, 19 nt, Artificial Sequence
  Synthetic Oligonucleotide
cuucguuggcugcaacugu

SEQ ID NO: 11036 - RNA, 19 nt, Artificial Sequence
  Synthetic Oligonucleotide
uuuauuucauugcuuuuga

SEQ ID NO: 11037 - RNA, 19 nt, Artificial Sequence
  Synthetic Oligonucleotide
uauuuucccaucuguauua

SEQ ID NO: 11038 - RNA, 19 nt, Artificial Sequence
  Synthetic Oligonucleotide
acaucauugccaauuguug

SEQ ID NO: 11039 - RNA, 19 nt, Artificial Sequence
  Synthetic Oligonucleotide
gaaauaaagcauuuuuggg

SEQ ID NO: 11040 - RNA, 19 nt, Artificial Sequence
  Synthetic Oligonucleotide
agucuguaauuccccacuu

SEQ ID NO: 11041 - RNA, 19 nt, Artificial Sequence
  Synthetic Oligonucleotide
ugagaagacugacaucauu

SEQ ID NO: 11042 - RNA, 19 nt, Artificial Sequence
  Synthetic Oligonucleotide
cuuuuccaacaaaauagca

SEQ ID NO: 11043 - RNA, 19 nt, Artificial Sequence
  Synthetic Oligonucleotide
cacuauugauguucugcca

SEQ ID NO: 11044 - RNA, 19 nt, Artificial Sequence
  Synthetic Oligonucleotide
acaacaugcuaaaucagua

SEQ ID NO: 11045 - RNA, 19 nt, Artificial Sequence
  Synthetic Oligonucleotide
cuuuaguaaaauuggaggu

SEQ ID NO: 11046 - RNA, 19 nt, Artificial Sequence
  Synthetic Oligonucleotide
cuuuugacuuuucaauggg

SEQ ID NO: 11047 - RNA, 19 nt, Artificial Sequence
  Synthetic Oligonucleotide
cuuuuagaaagaaauggac

SEQ ID NO: 11048 - RNA, 19 nt, Artificial Sequence
  Synthetic Oligonucleotide
aaucacaucuuuagugucu

SEQ ID NO: 11049 - RNA, 19 nt, Artificial Sequence
  Synthetic Oligonucleotide
uauugcagcauuuuccaga

SEQ ID NO: 11050 - RNA, 19 nt, Artificial Sequence
  Synthetic Oligonucleotide
uggcugcaacuguauaucu

SEQ ID NO: 11051 - RNA, 19 nt, Artificial Sequence
  Synthetic Oligonucleotide
uuacuugacaaagagacac

SEQ ID NO: 11052 - RNA, 19 nt, Artificial Sequence
  Synthetic Oligonucleotide
aucuaucagcugggaagau

SEQ ID NO: 11053 - RNA, 19 nt, Artificial Sequence
  Synthetic Oligonucleotide
uuagugucugaauauaucc

SEQ ID NO: 11054 - RNA, 19 nt, Artificial Sequence
  Synthetic Oligonucleotide
ucacaucuuuagugucuga

SEQ ID NO: 11055 - RNA, 19 nt, Artificial Sequence
  Synthetic Oligonucleotide
aaucccuuuuauuucauug

SEQ ID NO: 11056 - RNA, 19 nt, Artificial Sequence
  Synthetic Oligonucleotide
cuuuagugucugaauauau

SEQ ID NO: 11057 - RNA, 19 nt, Artificial Sequence
  Synthetic Oligonucleotide
uaaccuguauucuguuuac

SEQ ID NO: 11058 - RNA, 19 nt, Artificial Sequence
  Synthetic Oligonucleotide
caucauugccaauuguugc

SEQ ID NO: 11059 - RNA, 19 nt, Artificial Sequence
  Synthetic Oligonucleotide
aagggugucguucuuuucc

SEQ ID NO: 11060 - RNA, 19 nt, Artificial Sequence
  Synthetic Oligonucleotide
uccucgagauacuaaagga

SEQ ID NO: 11061 - RNA, 19 nt, Artificial Sequence
  Synthetic Oligonucleotide
uuacuucuuagagagaaau

SEQ ID NO: 11062 - RNA, 19 nt, Artificial Sequence
  Synthetic Oligonucleotide
acaaagggugucguucuuu

SEQ ID NO: 11063 - RNA, 19 nt, Artificial Sequence
  Synthetic Oligonucleotide
aggauguauguuacuucuu

SEQ ID NO: 11064 - RNA, 19 nt, Artificial Sequence
  Synthetic Oligonucleotide
ggcugauaauauugcagca

SEQ ID NO: 11065 - RNA, 19 nt, Artificial Sequence
  Synthetic Oligonucleotide
ccaagaucugacagugcac

SEQ ID NO: 11066 - RNA, 19 nt, Artificial Sequence
  Synthetic Oligonucleotide
aaauggcugagaagacuga

SEQ ID NO: 11067 - RNA, 19 nt, Artificial Sequence
  Synthetic Oligonucleotide
uuccaaagucuauauauga

SEQ ID NO: 11068 - RNA, 19 nt, Artificial Sequence
  Synthetic Oligonucleotide
agagagaaauaaagcauuu

SEQ ID NO: 11069 - RNA, 19 nt, Artificial Sequence
  Synthetic Oligonucleotide
uacuucuuagagagaaaua

SEQ ID NO: 11070 - RNA, 19 nt, Artificial Sequence
  Synthetic Oligonucleotide
ggugccagaaugugaaagu

SEQ ID NO: 11071 - RNA, 19 nt, Artificial Sequence
  Synthetic Oligonucleotide
ucagguucaaaguguuggu

SEQ ID NO: 11072 - RNA, 19 nt, Artificial Sequence
  Synthetic Oligonucleotide
aagguagcacuggagagaa

SEQ ID NO: 11073 - RNA, 19 nt, Artificial Sequence
  Synthetic Oligonucleotide
acuaaggugaaaagauaau

SEQ ID NO: 11074 - RNA, 19 nt, Artificial Sequence
  Synthetic Oligonucleotide
aauauugcagcauuuucca

SEQ ID NO: 11075 - RNA, 19 nt, Artificial Sequence
  Synthetic Oligonucleotide
agaaauggacuuucauccu

SEQ ID NO: 11076 - RNA, 19 nt, Artificial Sequence
  Synthetic Oligonucleotide
uuagagagaaauaaagcau

SEQ ID NO: 11077 - RNA, 19 nt, Artificial Sequence
  Synthetic Oligonucleotide
ugguucuuaaauuguaagc

SEQ ID NO: 11078 - RNA, 19 nt, Artificial Sequence
  Synthetic Oligonucleotide
uuaucauuuucuccugagg

SEQ ID NO: 11079 - RNA, 19 nt, Artificial Sequence
  Synthetic Oligonucleotide
uacuucuuugaauguagau

SEQ ID NO: 11080 - RNA, 19 nt, Artificial Sequence
  Synthetic Oligonucleotide
ucuuaaauuguaagcucag

SEQ ID NO: 11081 - RNA, 19 nt, Artificial Sequence
  Synthetic Oligonucleotide
augcuaaaucaguacuucc

SEQ ID NO: 11082 - RNA, 19 nt, Artificial Sequence
  Synthetic Oligonucleotide
aauguugcugaaacagauc

SEQ ID NO: 11083 - RNA, 19 nt, Artificial Sequence
  Synthetic Oligonucleotide
uguaagcucagguucaaag

SEQ ID NO: 11084 - RNA, 19 nt, Artificial Sequence
  Synthetic Oligonucleotide
aucugucgacuucuguuuu

SEQ ID NO: 11085 - RNA, 19 nt, Artificial Sequence
  Synthetic Oligonucleotide
acaaggccauauuugugac

SEQ ID NO: 11086 - RNA, 19 nt, Artificial Sequence
  Synthetic Oligonucleotide
caugucuuuaaaacagugg

SEQ ID NO: 11087 - RNA, 19 nt, Artificial Sequence
  Synthetic Oligonucleotide
aauuccccacuucaauaca

SEQ ID NO: 11088 - RNA, 19 nt, Artificial Sequence
  Synthetic Oligonucleotide
cuggaugaugugcguaaca

SEQ ID NO: 11089 - RNA, 19 nt, Artificial Sequence
  Synthetic Oligonucleotide
gagguagcaaacacuaagg

SEQ ID NO: 11090 - RNA, 19 nt, Artificial Sequence
  Synthetic Oligonucleotide
cuuagagagaaauaaagca

SEQ ID NO: 11091 - RNA, 19 nt, Artificial Sequence
  Synthetic Oligonucleotide
guuuuaggauguauguuac

SEQ ID NO: 11092 - RNA, 19 nt, Artificial Sequence
  Synthetic Oligonucleotide
guccucgagauacuaaagg

SEQ ID NO: 11093 - RNA, 19 nt, Artificial Sequence
  Synthetic Oligonucleotide
cugauucacaacuuugaga

SEQ ID NO: 11094 - RNA, 19 nt, Artificial Sequence
  Synthetic Oligonucleotide
cuguuuacaugucuuuaaa

SEQ ID NO: 11095 - RNA, 19 nt, Artificial Sequence
  Synthetic Oligonucleotide
gauaucaaauggcugagaa

SEQ ID NO: 11096 - RNA, 19 nt, Artificial Sequence
  Synthetic Oligonucleotide
uggcugauaauauugcagc

SEQ ID NO: 11097 - RNA, 19 nt, Artificial Sequence
  Synthetic Oligonucleotide
cagauggaagcuguaucca

SEQ ID NO: 11098 - RNA, 19 nt, Artificial Sequence
  Synthetic Oligonucleotide
uucguuggcugcaacugua

SEQ ID NO: 11099 - RNA, 19 nt, Artificial Sequence
  Synthetic Oligonucleotide
agguagcacuggagagaau

SEQ ID NO: 11100 - RNA, 19 nt, Artificial Sequence
  Synthetic Oligonucleotide
uguugcugaaacagaucug

SEQ ID NO: 11101 - RNA, 19 nt, Artificial Sequence
  Synthetic Oligonucleotide
uuggcugcaacuguauauc

SEQ ID NO: 11102 - RNA, 19 nt, Artificial Sequence
  Synthetic Oligonucleotide
agaaagaaauggacuuuca

SEQ ID NO: 11103 - RNA, 19 nt, Artificial Sequence
  Synthetic Oligonucleotide
ugcacaauauuuucccauc

SEQ ID NO: 11104 - RNA, 19 nt, Artificial Sequence
  Synthetic Oligonucleotide
gugcacaauauuuucccau

SEQ ID NO: 11105 - RNA, 19 nt, Artificial Sequence
  Synthetic Oligonucleotide
uucacaacuuugagaaggu

SEQ ID NO: 11106 - RNA, 19 nt, Artificial Sequence
  Synthetic Oligonucleotide
ugcuccggaauguugcuga

SEQ ID NO: 11107 - RNA, 19 nt, Artificial Sequence
  Synthetic Oligonucleotide
ucaauacaaagggugucgu

SEQ ID NO: 11108 - RNA, 19 nt, Artificial Sequence
  Synthetic Oligonucleotide
caacuguauaucuacaagg

SEQ ID NO: 11109 - RNA, 19 nt, Artificial Sequence
  Synthetic Oligonucleotide
ugaauguagauuuccaauc

SEQ ID NO: 11110 - RNA, 19 nt, Artificial Sequence
  Synthetic Oligonucleotide
auguauguuacuucuuaga

SEQ ID NO: 11111 - RNA, 19 nt, Artificial Sequence
  Synthetic Oligonucleotide
uguuuuaggauguauguua

SEQ ID NO: 11112 - RNA, 19 nt, Artificial Sequence
  Synthetic Oligonucleotide
ugaugugcguaacagauuc

SEQ ID NO: 11113 - RNA, 19 nt, Artificial Sequence
  Synthetic Oligonucleotide
aguaaaauuggagguagca

SEQ ID NO: 11114 - RNA, 19 nt, Artificial Sequence
  Synthetic Oligonucleotide
guguucaagauguccucga

SEQ ID NO: 11115 - RNA, 19 nt, Artificial Sequence
  Synthetic Oligonucleotide
acuucuuagagagaaauaa

SEQ ID NO: 11116 - RNA, 19 nt, Artificial Sequence
  Synthetic Oligonucleotide
acagugcacaauauuuucc

SEQ ID NO: 11117 - RNA, 19 nt, Artificial Sequence
  Synthetic Oligonucleotide
gguguucaagauguccucg

SEQ ID NO: 11118 - RNA, 19 nt, Artificial Sequence
  Synthetic Oligonucleotide
guuacuucuuagagagaaa

SEQ ID NO: 11119 - RNA, 19 nt, Artificial Sequence
  Synthetic Oligonucleotide
uacaaagggugucguucuu

SEQ ID NO: 11120 - RNA, 19 nt, Artificial Sequence
  Synthetic Oligonucleotide
augucuuuaaaacaguggu

SEQ ID NO: 11121 - RNA, 19 nt, Artificial Sequence
  Synthetic Oligonucleotide
agagggugaccacagucug

SEQ ID NO: 11122 - RNA, 19 nt, Artificial Sequence
  Synthetic Oligonucleotide
aaggaugcuccggaauguu

SEQ ID NO: 11123 - RNA, 19 nt, Artificial Sequence
  Synthetic Oligonucleotide
agagaaauaaagcauuuuu

SEQ ID NO: 11124 - RNA, 19 nt, Artificial Sequence
  Synthetic Oligonucleotide
uuugaauguagauuuccaa

SEQ ID NO: 11125 - RNA, 19 nt, Artificial Sequence
  Synthetic Oligonucleotide
guuuacaugucuuuaaaac

SEQ ID NO: 11126 - RNA, 19 nt, Artificial Sequence
  Synthetic Oligonucleotide
uuggagguagcaaacacua

SEQ ID NO: 11127 - RNA, 19 nt, Artificial Sequence
  Synthetic Oligonucleotide
aaagcaauagacccaucua

SEQ ID NO: 11128 - RNA, 19 nt, Artificial Sequence
  Synthetic Oligonucleotide
acaugcuaaaucaguacuu

SEQ ID NO: 11129 - RNA, 19 nt, Artificial Sequence
  Synthetic Oligonucleotide
cuucuuugaauguagauuu

SEQ ID NO: 11130 - RNA, 19 nt, Artificial Sequence
  Synthetic Oligonucleotide
ccaauuguugcaaagggca

SEQ ID NO: 11131 - RNA, 19 nt, Artificial Sequence
  Synthetic Oligonucleotide
cuaaagugcuguauccuuu

SEQ ID NO: 11132 - RNA, 19 nt, Artificial Sequence
  Synthetic Oligonucleotide
auuacuugacaaagagaca

SEQ ID NO: 11133 - RNA, 19 nt, Artificial Sequence
  Synthetic Oligonucleotide
uucuuaaauuguaagcuca

SEQ ID NO: 11134 - RNA, 19 nt, Artificial Sequence
  Synthetic Oligonucleotide
aaacagaucugucgacuuc

SEQ ID NO: 11135 - RNA, 19 nt, Artificial Sequence
  Synthetic Oligonucleotide
uaauauugcagcauuuucc

SEQ ID NO: 11136 - RNA, 19 nt, Artificial Sequence
  Synthetic Oligonucleotide
gauucacaacuuugagaag

SEQ ID NO: 11137 - RNA, 19 nt, Artificial Sequence
  Synthetic Oligonucleotide
gcauauguggcuaaagcaa

SEQ ID NO: 11138 - RNA, 19 nt, Artificial Sequence
  Synthetic Oligonucleotide
gggugucguucuuuuccaa

SEQ ID NO: 11139 - RNA, 19 nt, Artificial Sequence
  Synthetic Oligonucleotide
ccgucuggaugaugugcgu

SEQ ID NO: 11140 - RNA, 19 nt, Artificial Sequence
  Synthetic Oligonucleotide
uaggaaccuuuuagaaaga

SEQ ID NO: 11141 - RNA, 19 nt, Artificial Sequence
  Synthetic Oligonucleotide
gccacuauugauguucugc

SEQ ID NO: 11142 - RNA, 19 nt, Artificial Sequence
  Synthetic Oligonucleotide
caauacaaagggugucguu

SEQ ID NO: 11143 - RNA, 19 nt, Artificial Sequence
  Synthetic Oligonucleotide
ucuuugaauguagauuucc

SEQ ID NO: 11144 - RNA, 19 nt, Artificial Sequence
  Synthetic Oligonucleotide
ucguuggcugcaacuguau

SEQ ID NO: 11145 - RNA, 19 nt, Artificial Sequence
  Synthetic Oligonucleotide
gcaauaaccugugaaaaug

SEQ ID NO: 11146 - RNA, 19 nt, Artificial Sequence
  Synthetic Oligonucleotide
agucuauauaugacuauua

SEQ ID NO: 11147 - RNA, 19 nt, Artificial Sequence
  Synthetic Oligonucleotide
cauuuucuccugaggaaaa

SEQ ID NO: 11148 - RNA, 19 nt, Artificial Sequence
  Synthetic Oligonucleotide
cauauguggcuaaagcaau

SEQ ID NO: 11149 - RNA, 19 nt, Artificial Sequence
  Synthetic Oligonucleotide
cgacaguggacuugcugca

SEQ ID NO: 11150 - RNA, 19 nt, Artificial Sequence
  Synthetic Oligonucleotide
uuccaagaucugacagugc

SEQ ID NO: 11151 - RNA, 19 nt, Artificial Sequence
  Synthetic Oligonucleotide
augaugaagaaacuuuggc

SEQ ID NO: 11152 - RNA, 19 nt, Artificial Sequence
  Synthetic Oligonucleotide
gagggugaccacagucugu

SEQ ID NO: 11153 - RNA, 19 nt, Artificial Sequence
  Synthetic Oligonucleotide
agaaauaaagcauuuuugg

SEQ ID NO: 11154 - RNA, 19 nt, Artificial Sequence
  Synthetic Oligonucleotide
gaaugggaucuuggugucg

SEQ ID NO: 11155 - RNA, 19 nt, Artificial Sequence
  Synthetic Oligonucleotide
guaauuccccacuucaaua

SEQ ID NO: 11156 - RNA, 19 nt, Artificial Sequence
  Synthetic Oligonucleotide
cuguauccuuuaguaaaau

SEQ ID NO: 11157 - RNA, 19 nt, Artificial Sequence
  Synthetic Oligonucleotide
gaagguagcacuggagaga

SEQ ID NO: 11158 - RNA, 19 nt, Artificial Sequence
  Synthetic Oligonucleotide
agccacuauugauguucug

SEQ ID NO: 11159 - RNA, 19 nt, Artificial Sequence
  Synthetic Oligonucleotide
gacagugcacaauauuuuc

SEQ ID NO: 11160 - RNA, 19 nt, Artificial Sequence
  Synthetic Oligonucleotide
uccuaggaaccuuuuagaa

SEQ ID NO: 11161 - RNA, 19 nt, Artificial Sequence
  Synthetic Oligonucleotide
aaugggaucuuggugucga

SEQ ID NO: 11162 - RNA, 19 nt, Artificial Sequence
  Synthetic Oligonucleotide
agggugaccacagucugua

SEQ ID NO: 11163 - RNA, 19 nt, Artificial Sequence
  Synthetic Oligonucleotide
aucugacagugcacaauau

SEQ ID NO: 11164 - RNA, 19 nt, Artificial Sequence
  Synthetic Oligonucleotide
acuuccaaagucuauauau

SEQ ID NO: 11165 - RNA, 19 nt, Artificial Sequence
  Synthetic Oligonucleotide
uagaaagaaauggacuuuc

SEQ ID NO: 11166 - RNA, 19 nt, Artificial Sequence
  Synthetic Oligonucleotide
gugggugccagaaugugaa

SEQ ID NO: 11167 - RNA, 19 nt, Artificial Sequence
  Synthetic Oligonucleotide
gaggaaaauuuuggagacg

SEQ ID NO: 11168 - RNA, 19 nt, Artificial Sequence
  Synthetic Oligonucleotide
gggugccagccacuauuga

SEQ ID NO: 11169 - RNA, 19 nt, Artificial Sequence
  Synthetic Oligonucleotide
ccggcuaauuuguaucaau

SEQ ID NO: 11170 - RNA, 19 nt, Artificial Sequence
  Synthetic Oligonucleotide
cagagggugaccacagucu

SEQ ID NO: 11171 - RNA, 19 nt, Artificial Sequence
  Synthetic Oligonucleotide
aaggccauauuugugacag

SEQ ID NO: 11172 - RNA, 19 nt, Artificial Sequence
  Synthetic Oligonucleotide
cuuuaaaacagugguucuu

SEQ ID NO: 11173 - RNA, 19 nt, Artificial Sequence
  Synthetic Oligonucleotide
cucgagauacuaaaggaag

SEQ ID NO: 11174 - RNA, 19 nt, Artificial Sequence
  Synthetic Oligonucleotide
agcaauagacccaucuauc

SEQ ID NO: 11175 - RNA, 19 nt, Artificial Sequence
  Synthetic Oligonucleotide
auuuuccagauggaagcug

SEQ ID NO: 11176 - RNA, 19 nt, Artificial Sequence
  Synthetic Oligonucleotide
ugcuaaaucaguacuucca

SEQ ID NO: 11177 - RNA, 19 nt, Artificial Sequence
  Synthetic Oligonucleotide
uuuuagaaagaaauggacu

SEQ ID NO: 11178 - RNA, 19 nt, Artificial Sequence
  Synthetic Oligonucleotide
uacuuuaucauuuucuccu

SEQ ID NO: 11179 - RNA, 19 nt, Artificial Sequence
  Synthetic Oligonucleotide
aaaucaguacuuccaaagu

SEQ ID NO: 11180 - RNA, 19 nt, Artificial Sequence
  Synthetic Oligonucleotide
cagaucugucgacuucugu

SEQ ID NO: 11181 - RNA, 19 nt, Artificial Sequence
  Synthetic Oligonucleotide
gacauuggugaggaaaaau

SEQ ID NO: 11182 - RNA, 19 nt, Artificial Sequence
  Synthetic Oligonucleotide
uccaacaaaauagcaaucc

SEQ ID NO: 11183 - RNA, 19 nt, Artificial Sequence
  Synthetic Oligonucleotide
acagaucugucgacuucug

SEQ ID NO: 11184 - RNA, 19 nt, Artificial Sequence
  Synthetic Oligonucleotide
acuguauaucuacaaggac

SEQ ID NO: 11185 - RNA, 19 nt, Artificial Sequence
  Synthetic Oligonucleotide
ugauucacaacuuugagaa

SEQ ID NO: 11186 - RNA, 19 nt, Artificial Sequence
  Synthetic Oligonucleotide
aacuuuggcugauaauauu

SEQ ID NO: 11187 - RNA, 19 nt, Artificial Sequence
  Synthetic Oligonucleotide
ccaaucacaucuuuagugu

SEQ ID NO: 11188 - RNA, 19 nt, Artificial Sequence
  Synthetic Oligonucleotide
gcuccggaauguugcugaa

SEQ ID NO: 11189 - RNA, 19 nt, Artificial Sequence
  Synthetic Oligonucleotide
uaauuccccacuucaauac

SEQ ID NO: 11190 - RNA, 19 nt, Artificial Sequence
  Synthetic Oligonucleotide
accuuuuagaaagaaaugg

SEQ ID NO: 11191 - RNA, 19 nt, Artificial Sequence
  Synthetic Oligonucleotide
uguucaagauguccucgag

SEQ ID NO: 11192 - RNA, 19 nt, Artificial Sequence
  Synthetic Oligonucleotide
auuccccacuucaauacaa

SEQ ID NO: 11193 - RNA, 19 nt, Artificial Sequence
  Synthetic Oligonucleotide
gcugcaacuguauaucuac

SEQ ID NO: 11194 - RNA, 19 nt, Artificial Sequence
  Synthetic Oligonucleotide
gucuuuaaaacagugguuc

SEQ ID NO: 11195 - RNA, 19 nt, Artificial Sequence
  Synthetic Oligonucleotide
acagagggucagcaugcca

SEQ ID NO: 11196 - RNA, 19 nt, Artificial Sequence
  Synthetic Oligonucleotide
gauguccucgagauacuaa

SEQ ID NO: 11197 - RNA, 19 nt, Artificial Sequence
  Synthetic Oligonucleotide
gcgguaauuggugauacuu

SEQ ID NO: 11198 - RNA, 19 nt, Artificial Sequence
  Synthetic Oligonucleotide
ucuuagagagaaauaaagc

SEQ ID NO: 11199 - RNA, 19 nt, Artificial Sequence
  Synthetic Oligonucleotide
aaaauuggagguagcaaac

SEQ ID NO: 11200 - RNA, 19 nt, Artificial Sequence
  Synthetic Oligonucleotide
ucuuuaaaacagugguucu

SEQ ID NO: 11201 - RNA, 19 nt, Artificial Sequence
  Synthetic Oligonucleotide
ggauguauguuacuucuua

SEQ ID NO: 11202 - RNA, 19 nt, Artificial Sequence
  Synthetic Oligonucleotide
guauccuuuaguaaaauug

SEQ ID NO: 11203 - RNA, 19 nt, Artificial Sequence
  Synthetic Oligonucleotide
gcauuuuccagauggaagc

SEQ ID NO: 11204 - RNA, 19 nt, Artificial Sequence
  Synthetic Oligonucleotide
acaacuuugagaagguagc

SEQ ID NO: 11205 - RNA, 19 nt, Artificial Sequence
  Synthetic Oligonucleotide
ucuuuuccaacaaaauagc

SEQ ID NO: 11206 - RNA, 19 nt, Artificial Sequence
  Synthetic Oligonucleotide
gagugggugccagaaugug

SEQ ID NO: 11207 - RNA, 19 nt, Artificial Sequence
  Synthetic Oligonucleotide
ucaaauggcugagaagacu

SEQ ID NO: 11208 - RNA, 19 nt, Artificial Sequence
  Synthetic Oligonucleotide
ccgccacaacucaggauga

SEQ ID NO: 11209 - RNA, 19 nt, Artificial Sequence
  Synthetic Oligonucleotide
ggaugcuccggaauguugc

SEQ ID NO: 11210 - RNA, 19 nt, Artificial Sequence
  Synthetic Oligonucleotide
agguagcaaacacuaaggu

SEQ ID NO: 11211 - RNA, 19 nt, Artificial Sequence
  Synthetic Oligonucleotide
acagucuguaauuccccac

SEQ ID NO: 11212 - RNA, 19 nt, Artificial Sequence
  Synthetic Oligonucleotide
auguugcugaaacagaucu

SEQ ID NO: 11213 - RNA, 19 nt, Artificial Sequence
  Synthetic Oligonucleotide
uaaaucaguacuuccaaag

SEQ ID NO: 11214 - RNA, 19 nt, Artificial Sequence
  Synthetic Oligonucleotide
aacuguauaucuacaagga

SEQ ID NO: 11215 - RNA, 19 nt, Artificial Sequence
  Synthetic Oligonucleotide
caugcuaaaucaguacuuc

SEQ ID NO: 11216 - RNA, 19 nt, Artificial Sequence
  Synthetic Oligonucleotide
auaucaaauggcugagaag

SEQ ID NO: 11217 - RNA, 19 nt, Artificial Sequence
  Synthetic Oligonucleotide
cuucuuagagagaaauaaa

SEQ ID NO: 11218 - RNA, 19 nt, Artificial Sequence
  Synthetic Oligonucleotide
cgucuggaugaugugcgua

SEQ ID NO: 11219 - RNA, 19 nt, Artificial Sequence
  Synthetic Oligonucleotide
gccaauuguugcaaagggc

SEQ ID NO: 11220 - RNA, 19 nt, Artificial Sequence
  Synthetic Oligonucleotide
caaagggugucguucuuuu

SEQ ID NO: 11221 - RNA, 19 nt, Artificial Sequence
  Synthetic Oligonucleotide
ucaucgacaagacauuggu

SEQ ID NO: 11222 - RNA, 19 nt, Artificial Sequence
  Synthetic Oligonucleotide
uuuggcugauaauauugca

SEQ ID NO: 11223 - RNA, 19 nt, Artificial Sequence
  Synthetic Oligonucleotide
cuugcugcauauguggcua

SEQ ID NO: 11224 - RNA, 19 nt, Artificial Sequence
  Synthetic Oligonucleotide
uuuuccaacaaaauagcaa

SEQ ID NO: 11225 - RNA, 19 nt, Artificial Sequence
  Synthetic Oligonucleotide
cacuucaauacaaagggug

SEQ ID NO: 11226 - RNA, 19 nt, Artificial Sequence
  Synthetic Oligonucleotide
uauccaaauguuuuaggau

SEQ ID NO: 11227 - RNA, 19 nt, Artificial Sequence
  Synthetic Oligonucleotide
ucuaucagcugggaagaua

SEQ ID NO: 11228 - RNA, 19 nt, Artificial Sequence
  Synthetic Oligonucleotide
gacaguggacuugcugcau

SEQ ID NO: 11229 - RNA, 19 nt, Artificial Sequence
  Synthetic Oligonucleotide
guccuaggaaccuuuuaga

SEQ ID NO: 11230 - RNA, 19 nt, Artificial Sequence
  Synthetic Oligonucleotide
ccacagucuguaauucccc

SEQ ID NO: 11231 - RNA, 19 nt, Artificial Sequence
  Synthetic Oligonucleotide
accgucuggaugaugugcg

SEQ ID NO: 11232 - RNA, 19 nt, Artificial Sequence
  Synthetic Oligonucleotide
cugcaacuguauaucuaca

SEQ ID NO: 11233 - RNA, 19 nt, Artificial Sequence
  Synthetic Oligonucleotide
caaggaugcuccggaaugu

SEQ ID NO: 11234 - RNA, 19 nt, Artificial Sequence
  Synthetic Oligonucleotide
aggaugcuccggaauguug

SEQ ID NO: 11235 - RNA, 19 nt, Artificial Sequence
  Synthetic Oligonucleotide
guugcugaaacagaucugu

SEQ ID NO: 11236 - RNA, 19 nt, Artificial Sequence
  Synthetic Oligonucleotide
aagggcauuuugagaggug

SEQ ID NO: 11237 - RNA, 19 nt, Artificial Sequence
  Synthetic Oligonucleotide
uaaagcaauagacccaucu

SEQ ID NO: 11238 - RNA, 19 nt, Artificial Sequence
  Synthetic Oligonucleotide
caagauguccucgagauac

SEQ ID NO: 11239 - RNA, 19 nt, Artificial Sequence
  Synthetic Oligonucleotide
gaccacagucuguaauucc

SEQ ID NO: 11240 - RNA, 19 nt, Artificial Sequence
  Synthetic Oligonucleotide
aagucaucgacaagacauu

SEQ ID NO: 11241 - RNA, 19 nt, Artificial Sequence
  Synthetic Oligonucleotide
ggaagauaucaaauggcug

SEQ ID NO: 11242 - RNA, 19 nt, Artificial Sequence
  Synthetic Oligonucleotide
ccugaggaaaauuuuggag

SEQ ID NO: 11243 - RNA, 19 nt, Artificial Sequence
  Synthetic Oligonucleotide
gauguucugccagaaauug

SEQ ID NO: 11244 - RNA, 19 nt, Artificial Sequence
  Synthetic Oligonucleotide
ccagccacuauugauguuc

SEQ ID NO: 11245 - RNA, 19 nt, Artificial Sequence
  Synthetic Oligonucleotide
aaagggugucguucuuuuc

SEQ ID NO: 11246 - RNA, 19 nt, Artificial Sequence
  Synthetic Oligonucleotide
ucgacaagacauuggugag

SEQ ID NO: 11247 - RNA, 19 nt, Artificial Sequence
  Synthetic Oligonucleotide
aaaggcacugauguucuga

SEQ ID NO: 11248 - RNA, 19 nt, Artificial Sequence
  Synthetic Oligonucleotide
ggugaccacagucuguaau

SEQ ID NO: 11249 - RNA, 19 nt, Artificial Sequence
  Synthetic Oligonucleotide
cgccacaacucaggaugaa

SEQ ID NO: 11250 - RNA, 19 nt, Artificial Sequence
  Synthetic Oligonucleotide
ggcgguaauuggugauacu

SEQ ID NO: 11251 - RNA, 19 nt, Artificial Sequence
  Synthetic Oligonucleotide
ugcuuuugacuuuucaaug

SEQ ID NO: 11252 - RNA, 19 nt, Artificial Sequence
  Synthetic Oligonucleotide
auggguguccuaggaaccu

SEQ ID NO: 11253 - RNA, 19 nt, Artificial Sequence
  Synthetic Oligonucleotide
uggagguagcaaacacuaa

SEQ ID NO: 11254 - RNA, 19 nt, Artificial Sequence
  Synthetic Oligonucleotide
ugaaacagaucugucgacu

SEQ ID NO: 11255 - RNA, 19 nt, Artificial Sequence
  Synthetic Oligonucleotide
caaggccauauuugugaca

SEQ ID NO: 11256 - RNA, 19 nt, Artificial Sequence
  Synthetic Oligonucleotide
ugcagcauuuuccagaugg

SEQ ID NO: 11257 - RNA, 19 nt, Artificial Sequence
  Synthetic Oligonucleotide
cuaaaucaguacuuccaaa

SEQ ID NO: 11258 - RNA, 19 nt, Artificial Sequence
  Synthetic Oligonucleotide
gugguucuuaaauuguaag

SEQ ID NO: 11259 - RNA, 19 nt, Artificial Sequence
  Synthetic Oligonucleotide
uugcuuuugacuuuucaau

SEQ ID NO: 11260 - RNA, 19 nt, Artificial Sequence
  Synthetic Oligonucleotide
gagaaauaaagcauuuuug

SEQ ID NO: 11261 - RNA, 19 nt, Artificial Sequence
  Synthetic Oligonucleotide
guagauuuccaaucacauc

SEQ ID NO: 11262 - RNA, 19 nt, Artificial Sequence
  Synthetic Oligonucleotide
ccagauggaagcuguaucc

SEQ ID NO: 11263 - RNA, 19 nt, Artificial Sequence
  Synthetic Oligonucleotide
auuguugcaaagggcauuu

SEQ ID NO: 11264 - RNA, 19 nt, Artificial Sequence
  Synthetic Oligonucleotide
cuacaaggaccgagaaguc

SEQ ID NO: 11265 - RNA, 19 nt, Artificial Sequence
  Synthetic Oligonucleotide
ugagaagguagcacuggag

SEQ ID NO: 11266 - RNA, 19 nt, Artificial Sequence
  Synthetic Oligonucleotide
ggagguagcaaacacuaag

SEQ ID NO: 11267 - RNA, 19 nt, Artificial Sequence
  Synthetic Oligonucleotide
aaggaccgagaagucacca

SEQ ID NO: 11268 - RNA, 19 nt, Artificial Sequence
  Synthetic Oligonucleotide
cuacaaggccauauuugug

SEQ ID NO: 11269 - RNA, 19 nt, Artificial Sequence
  Synthetic Oligonucleotide
aguacuuuaucauuuucuc

SEQ ID NO: 11270 - RNA, 19 nt, Artificial Sequence
  Synthetic Oligonucleotide
gauuuccaaucacaucuuu

SEQ ID NO: 11271 - RNA, 19 nt, Artificial Sequence
  Synthetic Oligonucleotide
uaggauguauguuacuucu

SEQ ID NO: 11272 - RNA, 19 nt, Artificial Sequence
  Synthetic Oligonucleotide
uuuaucauuuucuccugag

SEQ ID NO: 11273 - RNA, 19 nt, Artificial Sequence
  Synthetic Oligonucleotide
ucuggaugaugugcguaac

SEQ ID NO: 11274 - RNA, 19 nt, Artificial Sequence
  Synthetic Oligonucleotide
uguauaucuacaaggaccg

SEQ ID NO: 11275 - RNA, 19 nt, Artificial Sequence
  Synthetic Oligonucleotide
aaugaugaagaaacuuugg

SEQ ID NO: 11276 - RNA, 19 nt, Artificial Sequence
  Synthetic Oligonucleotide
gaucugucgacuucuguuu

SEQ ID NO: 11277 - RNA, 19 nt, Artificial Sequence
  Synthetic Oligonucleotide
gguagcacuggagagaauu

SEQ ID NO: 11278 - RNA, 19 nt, Artificial Sequence
  Synthetic Oligonucleotide
aagaaauggacuuucaucc

SEQ ID NO: 11279 - RNA, 19 nt, Artificial Sequence
  Synthetic Oligonucleotide
aaggcacugauguucugaa

SEQ ID NO: 11280 - RNA, 19 nt, Artificial Sequence
  Synthetic Oligonucleotide
uggcugagaagacugacau

SEQ ID NO: 11281 - RNA, 19 nt, Artificial Sequence
  Synthetic Oligonucleotide
cagccacuauugauguucu

SEQ ID NO: 11282 - RNA, 19 nt, Artificial Sequence
  Synthetic Oligonucleotide
gcaacuguauaucuacaag

SEQ ID NO: 11283 - RNA, 19 nt, Artificial Sequence
  Synthetic Oligonucleotide
aaagguguucaagaugucc

SEQ ID NO: 11284 - RNA, 19 nt, Artificial Sequence
  Synthetic Oligonucleotide
uuuuaggauguauguuacu

SEQ ID NO: 11285 - RNA, 19 nt, Artificial Sequence
  Synthetic Oligonucleotide
gguguccuaggaaccuuuu

SEQ ID NO: 11286 - RNA, 19 nt, Artificial Sequence
  Synthetic Oligonucleotide
aacagaucugucgacuucu

SEQ ID NO: 11287 - RNA, 19 nt, Artificial Sequence
  Synthetic Oligonucleotide
aagauaucaaauggcugag

SEQ ID NO: 11288 - RNA, 19 nt, Artificial Sequence
  Synthetic Oligonucleotide
auugcagcauuuuccagau

SEQ ID NO: 11289 - RNA, 19 nt, Artificial Sequence
  Synthetic Oligonucleotide
aauacaaagggugucguuc

SEQ ID NO: 11290 - RNA, 19 nt, Artificial Sequence
  Synthetic Oligonucleotide
acuuuucaauggguguccu

SEQ ID NO: 11291 - RNA, 19 nt, Artificial Sequence
  Synthetic Oligonucleotide
gcuuuugacuuuucaaugg

SEQ ID NO: 11292 - RNA, 19 nt, Artificial Sequence
  Synthetic Oligonucleotide
uugcugaaacagaucuguc

SEQ ID NO: 11293 - RNA, 19 nt, Artificial Sequence
  Synthetic Oligonucleotide
gaauguugcugaaacagau

SEQ ID NO: 11294 - RNA, 19 nt, Artificial Sequence
  Synthetic Oligonucleotide
gcuaaagugcuguauccuu

SEQ ID NO: 11295 - RNA, 19 nt, Artificial Sequence
  Synthetic Oligonucleotide
ggcuaaagugcuguauccu

SEQ ID NO: 11296 - RNA, 19 nt, Artificial Sequence
  Synthetic Oligonucleotide
gagaagguagcacuggaga

SEQ ID NO: 11297 - RNA, 19 nt, Artificial Sequence
  Synthetic Oligonucleotide
ggcuaaagcaauagaccca

SEQ ID NO: 11298 - RNA, 19 nt, Artificial Sequence
  Synthetic Oligonucleotide
aauuguugcaaagggcauu

SEQ ID NO: 11299 - RNA, 19 nt, Artificial Sequence
  Synthetic Oligonucleotide
uaguaaaauuggagguagc

SEQ ID NO: 11300 - RNA, 19 nt, Artificial Sequence
  Synthetic Oligonucleotide
uauaucuacaaggaccgag

SEQ ID NO: 11301 - RNA, 19 nt, Artificial Sequence
  Synthetic Oligonucleotide
uauguggcuaaagcaauag

SEQ ID NO: 11302 - RNA, 19 nt, Artificial Sequence
  Synthetic Oligonucleotide
auuggagguagcaaacacu

SEQ ID NO: 11303 - RNA, 19 nt, Artificial Sequence
  Synthetic Oligonucleotide
auaucuacaaggaccgaga

SEQ ID NO: 11304 - RNA, 19 nt, Artificial Sequence
  Synthetic Oligonucleotide
guggacuugcugcauaugu

SEQ ID NO: 11305 - RNA, 19 nt, Artificial Sequence
  Synthetic Oligonucleotide
uauccuuuaguaaaauugg

SEQ ID NO: 11306 - RNA, 19 nt, Artificial Sequence
  Synthetic Oligonucleotide
uacuugacaaagagacacu

SEQ ID NO: 11307 - RNA, 19 nt, Artificial Sequence
  Synthetic Oligonucleotide
gacuuuucaaugggugucc

SEQ ID NO: 11308 - RNA, 19 nt, Artificial Sequence
  Synthetic Oligonucleotide
uuagaaagaaauggacuuu

SEQ ID NO: 11309 - RNA, 19 nt, Artificial Sequence
  Synthetic Oligonucleotide
augcuccggaauguugcug

SEQ ID NO: 11310 - RNA, 19 nt, Artificial Sequence
  Synthetic Oligonucleotide
gaaagaaauggacuuucau

SEQ ID NO: 11311 - RNA, 19 nt, Artificial Sequence
  Synthetic Oligonucleotide
uuuacaugucuuuaaaaca

SEQ ID NO: 11312 - RNA, 19 nt, Artificial Sequence
  Synthetic Oligonucleotide
ugaugaagaaacuuuggcu

SEQ ID NO: 11313 - RNA, 19 nt, Artificial Sequence
  Synthetic Oligonucleotide
acgacaguggacuugcugc

SEQ ID NO: 11314 - RNA, 19 nt, Artificial Sequence
  Synthetic Oligonucleotide
agaucugucgacuucuguu

SEQ ID NO: 11315 - RNA, 19 nt, Artificial Sequence
  Synthetic Oligonucleotide
auguggcuaaagcaauaga

SEQ ID NO: 11316 - RNA, 19 nt, Artificial Sequence
  Synthetic Oligonucleotide
cggaaaggcacugauguuc

SEQ ID NO: 11317 - RNA, 19 nt, Artificial Sequence
  Synthetic Oligonucleotide
ugcauauguggcuaaagca

SEQ ID NO: 11318 - RNA, 19 nt, Artificial Sequence
  Synthetic Oligonucleotide
gagacgacaguggacuugc

SEQ ID NO: 11319 - RNA, 19 nt, Artificial Sequence
  Synthetic Oligonucleotide
gcagagggugaccacaguc

SEQ ID NO: 11320 - RNA, 19 nt, Artificial Sequence
  Synthetic Oligonucleotide
uuuagugucugaauauauc

SEQ ID NO: 11321 - RNA, 19 nt, Artificial Sequence
  Synthetic Oligonucleotide
ucaagauguccucgagaua

SEQ ID NO: 11322 - RNA, 19 nt, Artificial Sequence
  Synthetic Oligonucleotide
uaaaauuggagguagcaaa

SEQ ID NO: 11323 - RNA, 19 nt, Artificial Sequence
  Synthetic Oligonucleotide
ucacaacuuugagaaggua

SEQ ID NO: 11324 - RNA, 19 nt, Artificial Sequence
  Synthetic Oligonucleotide
uaucaaauggcugagaaga

SEQ ID NO: 11325 - RNA, 19 nt, Artificial Sequence
  Synthetic Oligonucleotide
agaaagguguucaagaugu

SEQ ID NO: 11326 - RNA, 19 nt, Artificial Sequence
  Synthetic Oligonucleotide
agauuuccaaucacaucuu

SEQ ID NO: 11327 - RNA, 19 nt, Artificial Sequence
  Synthetic Oligonucleotide
uugaauguagauuuccaau

SEQ ID NO: 11328 - RNA, 19 nt, Artificial Sequence
  Synthetic Oligonucleotide
uugcagcauuuuccagaug

SEQ ID NO: 11329 - RNA, 19 nt, Artificial Sequence
  Synthetic Oligonucleotide
ccacuucaauacaaagggu

SEQ ID NO: 11330 - RNA, 19 nt, Artificial Sequence
  Synthetic Oligonucleotide
uucuuugaauguagauuuc

SEQ ID NO: 11331 - RNA, 19 nt, Artificial Sequence
  Synthetic Oligonucleotide
uugcugcauauguggcuaa

SEQ ID NO: 11332 - RNA, 19 nt, Artificial Sequence
  Synthetic Oligonucleotide
uggguguccuaggaaccuu

SEQ ID NO: 11333 - RNA, 19 nt, Artificial Sequence
  Synthetic Oligonucleotide
cuaaagcaauagacccauc

SEQ ID NO: 11334 - RNA, 19 nt, Artificial Sequence
  Synthetic Oligonucleotide
gagauacuaaaggaagaau

SEQ ID NO: 11335 - RNA, 19 nt, Artificial Sequence
  Synthetic Oligonucleotide
ugcggaaaggcacugaugu

SEQ ID NO: 11336 - RNA, 19 nt, Artificial Sequence
  Synthetic Oligonucleotide
uuaggauguauguuacuuc

SEQ ID NO: 11337 - RNA, 19 nt, Artificial Sequence
  Synthetic Oligonucleotide
ggaaaauuuuggagacgac

SEQ ID NO: 11338 - RNA, 19 nt, Artificial Sequence
  Synthetic Oligonucleotide
uuuaguaaaauuggaggua

SEQ ID NO: 11339 - RNA, 19 nt, Artificial Sequence
  Synthetic Oligonucleotide
gacagagggucagcaugcc

SEQ ID NO: 11340 - RNA, 19 nt, Artificial Sequence
  Synthetic Oligonucleotide
ugucgacuucuguuuuagg

SEQ ID NO: 11341 - RNA, 19 nt, Artificial Sequence
  Synthetic Oligonucleotide
uuuaggauguauguuacuu

SEQ ID NO: 11342 - RNA, 19 nt, Artificial Sequence
  Synthetic Oligonucleotide
agcacuggagagaauugga

SEQ ID NO: 11343 - RNA, 19 nt, Artificial Sequence
  Synthetic Oligonucleotide
aauuggagguagcaaacac

SEQ ID NO: 11344 - RNA, 19 nt, Artificial Sequence
  Synthetic Oligonucleotide
ggcugagaagacugacauc

SEQ ID NO: 11345 - RNA, 19 nt, Artificial Sequence
  Synthetic Oligonucleotide
uccaaucacaucuuuagug

SEQ ID NO: 11346 - RNA, 19 nt, Artificial Sequence
  Synthetic Oligonucleotide
uucaauacaaagggugucg

SEQ ID NO: 11347 - RNA, 19 nt, Artificial Sequence
  Synthetic Oligonucleotide
guauaucuacaaggaccga

SEQ ID NO: 11348 - RNA, 19 nt, Artificial Sequence
  Synthetic Oligonucleotide
acuugcugcauauguggcu

SEQ ID NO: 11349 - RNA, 19 nt, Artificial Sequence
  Synthetic Oligonucleotide
acuuuggcugauaauauug

SEQ ID NO: 11350 - RNA, 19 nt, Artificial Sequence
  Synthetic Oligonucleotide
auuuuggagacgacagugg

SEQ ID NO: 11351 - RNA, 19 nt, Artificial Sequence
  Synthetic Oligonucleotide
cugucgacuucuguuuuag

SEQ ID NO: 11352 - RNA, 19 nt, Artificial Sequence
  Synthetic Oligonucleotide
cuggggcaaaugaugaaga

SEQ ID NO: 11353 - RNA, 19 nt, Artificial Sequence
  Synthetic Oligonucleotide
cuccugaggaaaauuuugg

SEQ ID NO: 11354 - RNA, 19 nt, Artificial Sequence
  Synthetic Oligonucleotide
uggcuaaagcaauagaccc

SEQ ID NO: 11355 - RNA, 19 nt, Artificial Sequence
  Synthetic Oligonucleotide
cagagggucagcaugccaa

SEQ ID NO: 11356 - RNA, 19 nt, Artificial Sequence
  Synthetic Oligonucleotide
uuugacuuuucaaugggug

SEQ ID NO: 11357 - RNA, 19 nt, Artificial Sequence
  Synthetic Oligonucleotide
gaaaggcacugauguucug

SEQ ID NO: 11358 - RNA, 19 nt, Artificial Sequence
  Synthetic Oligonucleotide
cacagucuguaauucccca

SEQ ID NO: 11359 - RNA, 19 nt, Artificial Sequence
  Synthetic Oligonucleotide
uuggcugauaauauugcag

SEQ ID NO: 11360 - RNA, 19 nt, Artificial Sequence
  Synthetic Oligonucleotide
gaaccuuuuagaaagaaau

SEQ ID NO: 11361 - RNA, 19 nt, Artificial Sequence
  Synthetic Oligonucleotide
ccucgagauacuaaaggaa

SEQ ID NO: 11362 - RNA, 19 nt, Artificial Sequence
  Synthetic Oligonucleotide
agauacuaaaggaagaauu

SEQ ID NO: 11363 - RNA, 19 nt, Artificial Sequence
  Synthetic Oligonucleotide
caucuaucagcugggaaga

SEQ ID NO: 11364 - RNA, 19 nt, Artificial Sequence
  Synthetic Oligonucleotide
cugaaacagaucugucgac

SEQ ID NO: 11365 - RNA, 19 nt, Artificial Sequence
  Synthetic Oligonucleotide
uuaguaaaauuggagguag

SEQ ID NO: 11366 - RNA, 19 nt, Artificial Sequence
  Synthetic Oligonucleotide
agacacugugcagagggug

SEQ ID NO: 11367 - RNA, 19 nt, Artificial Sequence
  Synthetic Oligonucleotide
ccuuuaguaaaauuggagg

SEQ ID NO: 11368 - RNA, 19 nt, Artificial Sequence
  Synthetic Oligonucleotide
agcauuuuccagauggaag

SEQ ID NO: 11369 - RNA, 19 nt, Artificial Sequence
  Synthetic Oligonucleotide
cuguauaucuacaaggacc

SEQ ID NO: 11370 - RNA, 19 nt, Artificial Sequence
  Synthetic Oligonucleotide
uuuugacuuuucaaugggu

SEQ ID NO: 11371 - RNA, 19 nt, Artificial Sequence
  Synthetic Oligonucleotide
uaaagugcuguauccuuua

SEQ ID NO: 11372 - RNA, 19 nt, Artificial Sequence
  Synthetic Oligonucleotide
ccuaggaaccuuuuagaaa

SEQ ID NO: 11373 - RNA, 19 nt, Artificial Sequence
  Synthetic Oligonucleotide
agagacacugugcagaggg

SEQ ID NO: 11374 - RNA, 19 nt, Artificial Sequence
  Synthetic Oligonucleotide
ggguguccuaggaaccuuu

SEQ ID NO: 11375 - RNA, 19 nt, Artificial Sequence
  Synthetic Oligonucleotide
acccaucuaucagcuggga

SEQ ID NO: 11376 - RNA, 19 nt, Artificial Sequence
  Synthetic Oligonucleotide
uuucuccugaggaaaauuu

SEQ ID NO: 11377 - RNA, 19 nt, Artificial Sequence
  Synthetic Oligonucleotide
aagcaauagacccaucuau

SEQ ID NO: 11378 - RNA, 19 nt, Artificial Sequence
  Synthetic Oligonucleotide
ggggugccagccacuauug

SEQ ID NO: 11379 - RNA, 19 nt, Artificial Sequence
  Synthetic Oligonucleotide
gaaacagaucugucgacuu

SEQ ID NO: 11380 - RNA, 19 nt, Artificial Sequence
  Synthetic Oligonucleotide
cccacuucaauacaaaggg

SEQ ID NO: 11381 - RNA, 19 nt, Artificial Sequence
  Synthetic Oligonucleotide
uuacaugucuuuaaaacag

SEQ ID NO: 11382 - RNA, 19 nt, Artificial Sequence
  Synthetic Oligonucleotide
agaagguagcacuggagag

SEQ ID NO: 11383 - RNA, 19 nt, Artificial Sequence
  Synthetic Oligonucleotide
guauccaaggaugcuccgg

SEQ ID NO: 11384 - RNA, 19 nt, Artificial Sequence
  Synthetic Oligonucleotide
caaagggcauuuugagagg

SEQ ID NO: 11385 - RNA, 19 nt, Artificial Sequence
  Synthetic Oligonucleotide
gguggcgguaauuggugau

SEQ ID NO: 11386 - RNA, 19 nt, Artificial Sequence
  Synthetic Oligonucleotide
caauuguugcaaagggcau

SEQ ID NO: 11387 - RNA, 19 nt, Artificial Sequence
  Synthetic Oligonucleotide
uguagauuuccaaucacau

SEQ ID NO: 11388 - RNA, 19 nt, Artificial Sequence
  Synthetic Oligonucleotide
acaaagagacacugugcag

SEQ ID NO: 11389 - RNA, 19 nt, Artificial Sequence
  Synthetic Oligonucleotide
gcugaaacagaucugucga

SEQ ID NO: 11390 - RNA, 19 nt, Artificial Sequence
  Synthetic Oligonucleotide
cugaggaaaauuuuggaga

SEQ ID NO: 11391 - RNA, 19 nt, Artificial Sequence
  Synthetic Oligonucleotide
uagagagaaauaaagcauu

SEQ ID NO: 11392 - RNA, 19 nt, Artificial Sequence
  Synthetic Oligonucleotide
gcuaaagcaauagacccau

SEQ ID NO: 11393 - RNA, 19 nt, Artificial Sequence
  Synthetic Oligonucleotide
cuaggaaccuuuuagaaag

SEQ ID NO: 11394 - RNA, 19 nt, Artificial Sequence
  Synthetic Oligonucleotide
aucauugccaauuguugca

SEQ ID NO: 11395 - RNA, 19 nt, Artificial Sequence
  Synthetic Oligonucleotide
agauggaagcuguauccaa

SEQ ID NO: 11396 - RNA, 19 nt, Artificial Sequence
  Synthetic Oligonucleotide
gugcagagggugaccacag

SEQ ID NO: 11397 - RNA, 19 nt, Artificial Sequence
  Synthetic Oligonucleotide
auggaagcuguauccaagg

SEQ ID NO: 11398 - RNA, 19 nt, Artificial Sequence
  Synthetic Oligonucleotide
ucauugccaauuguugcaa

SEQ ID NO: 11399 - RNA, 19 nt, Artificial Sequence
  Synthetic Oligonucleotide
agucaucgacaagacauug

SEQ ID NO: 11400 - RNA, 19 nt, Artificial Sequence
  Synthetic Oligonucleotide
guggcuaaagcaauagacc

SEQ ID NO: 11401 - RNA, 19 nt, Artificial Sequence
  Synthetic Oligonucleotide
gucuggaugaugugcguaa

SEQ ID NO: 11402 - RNA, 19 nt, Artificial Sequence
  Synthetic Oligonucleotide
cuccggaauguugcugaaa

SEQ ID NO: 11403 - RNA, 19 nt, Artificial Sequence
  Synthetic Oligonucleotide
uuccaacaaaauagcaauc

SEQ ID NO: 11404 - RNA, 19 nt, Artificial Sequence
  Synthetic Oligonucleotide
uuuagaaagaaauggacuu

SEQ ID NO: 11405 - RNA, 19 nt, Artificial Sequence
  Synthetic Oligonucleotide
ggaaaggcacugauguucu

SEQ ID NO: 11406 - RNA, 19 nt, Artificial Sequence
  Synthetic Oligonucleotide
aagguguucaagauguccu

SEQ ID NO: 11407 - RNA, 19 nt, Artificial Sequence
  Synthetic Oligonucleotide
gaaagguguucaagauguc

SEQ ID NO: 11408 - RNA, 19 nt, Artificial Sequence
  Synthetic Oligonucleotide
uguugcaaagggcauuuug

SEQ ID NO: 11409 - RNA, 19 nt, Artificial Sequence
  Synthetic Oligonucleotide
uucuuuuccaacaaaauag

SEQ ID NO: 11410 - RNA, 19 nt, Artificial Sequence
  Synthetic Oligonucleotide
acuucaauacaaagggugu

SEQ ID NO: 11411 - RNA, 19 nt, Artificial Sequence
  Synthetic Oligonucleotide
uccaagaucugacagugca

SEQ ID NO: 11412 - RNA, 19 nt, Artificial Sequence
  Synthetic Oligonucleotide
cuucaauacaaaggguguc

SEQ ID NO: 11413 - RNA, 19 nt, Artificial Sequence
  Synthetic Oligonucleotide
uuugagaagguagcacugg

SEQ ID NO: 11414 - RNA, 19 nt, Artificial Sequence
  Synthetic Oligonucleotide
gccgccacaacucaggaug

SEQ ID NO: 11415 - RNA, 19 nt, Artificial Sequence
  Synthetic Oligonucleotide
ugcugaaacagaucugucg

SEQ ID NO: 11416 - RNA, 19 nt, Artificial Sequence
  Synthetic Oligonucleotide
aaccuuuuagaaagaaaug

SEQ ID NO: 11417 - RNA, 19 nt, Artificial Sequence
  Synthetic Oligonucleotide
ugucuuuaaaacagugguu

SEQ ID NO: 11418 - RNA, 19 nt, Artificial Sequence
  Synthetic Oligonucleotide
ugauguucugccagaaauu

SEQ ID NO: 11419 - RNA, 19 nt, Artificial Sequence
  Synthetic Oligonucleotide
ggugccagccacuauugau

SEQ ID NO: 11420 - RNA, 19 nt, Artificial Sequence
  Synthetic Oligonucleotide
gacgacaguggacuugcug

SEQ ID NO: 11421 - RNA, 19 nt, Artificial Sequence
  Synthetic Oligonucleotide
uugcaaagggcauuuugag

SEQ ID NO: 11422 - RNA, 19 nt, Artificial Sequence
  Synthetic Oligonucleotide
ggaccgagaagucaccaag

SEQ ID NO: 11423 - RNA, 19 nt, Artificial Sequence
  Synthetic Oligonucleotide
ccggaauguugcugaaaca

SEQ ID NO: 11424 - RNA, 19 nt, Artificial Sequence
  Synthetic Oligonucleotide
ggucuggggcaaaugauga

SEQ ID NO: 11425 - RNA, 19 nt, Artificial Sequence
  Synthetic Oligonucleotide
gccagccacuauugauguu

SEQ ID NO: 11426 - RNA, 19 nt, Artificial Sequence
  Synthetic Oligonucleotide
gcggaaaggcacugauguu

SEQ ID NO: 11427 - RNA, 19 nt, Artificial Sequence
  Synthetic Oligonucleotide
ugcugcauauguggcuaaa

SEQ ID NO: 11428 - RNA, 19 nt, Artificial Sequence
  Synthetic Oligonucleotide
gggaagauaucaaauggcu

SEQ ID NO: 11429 - RNA, 19 nt, Artificial Sequence
  Synthetic Oligonucleotide
uguccuaggaaccuuuuag

SEQ ID NO: 11430 - RNA, 19 nt, Artificial Sequence
  Synthetic Oligonucleotide
cgagauacuaaaggaagaa

SEQ ID NO: 11431 - RNA, 19 nt, Artificial Sequence
  Synthetic Oligonucleotide
ggcuacaaggccauauuug

SEQ ID NO: 11432 - RNA, 19 nt, Artificial Sequence
  Synthetic Oligonucleotide
cacaacuuugagaagguag

SEQ ID NO: 11433 - RNA, 19 nt, Artificial Sequence
  Synthetic Oligonucleotide
acuucguuggcugcaacug

SEQ ID NO: 11434 - RNA, 19 nt, Artificial Sequence
  Synthetic Oligonucleotide
auguucugccagaaauugu

SEQ ID NO: 11435 - RNA, 19 nt, Artificial Sequence
  Synthetic Oligonucleotide
uagauuuccaaucacaucu

SEQ ID NO: 11436 - RNA, 19 nt, Artificial Sequence
  Synthetic Oligonucleotide
gacuugcugcauauguggc

SEQ ID NO: 11437 - RNA, 19 nt, Artificial Sequence
  Synthetic Oligonucleotide
cauuuuccagauggaagcu

SEQ ID NO: 11438 - RNA, 19 nt, Artificial Sequence
  Synthetic Oligonucleotide
acauuggugaggaaaaauc

SEQ ID NO: 11439 - RNA, 19 nt, Artificial Sequence
  Synthetic Oligonucleotide
ugccagccacuauugaugu

SEQ ID NO: 11440 - RNA, 19 nt, Artificial Sequence
  Synthetic Oligonucleotide
caaggaccgagaagucacc

SEQ ID NO: 11441 - RNA, 19 nt, Artificial Sequence
  Synthetic Oligonucleotide
aggccauauuugugacagu

SEQ ID NO: 11442 - RNA, 19 nt, Artificial Sequence
  Synthetic Oligonucleotide
uggcgguaauuggugauac

SEQ ID NO: 11443 - RNA, 19 nt, Artificial Sequence
  Synthetic Oligonucleotide
uauccaaggaugcuccgga

SEQ ID NO: 11444 - RNA, 19 nt, Artificial Sequence
  Synthetic Oligonucleotide
gauggaagcuguauccaag

SEQ ID NO: 11445 - RNA, 19 nt, Artificial Sequence
  Synthetic Oligonucleotide
aauggguguccuaggaacc

SEQ ID NO: 11446 - RNA, 19 nt, Artificial Sequence
  Synthetic Oligonucleotide
aacuuugagaagguagcac

SEQ ID NO: 11447 - RNA, 19 nt, Artificial Sequence
  Synthetic Oligonucleotide
acaugucuuuaaaacagug

SEQ ID NO: 11448 - RNA, 19 nt, Artificial Sequence
  Synthetic Oligonucleotide
uggguggcgguaauuggug

SEQ ID NO: 11449 - RNA, 19 nt, Artificial Sequence
  Synthetic Oligonucleotide
uucaauggguguccuagga

SEQ ID NO: 11450 - RNA, 19 nt, Artificial Sequence
  Synthetic Oligonucleotide
ugacaaagagacacugugc

SEQ ID NO: 11451 - RNA, 19 nt, Artificial Sequence
  Synthetic Oligonucleotide
aaagaaauggacuuucauc

SEQ ID NO: 11452 - RNA, 19 nt, Artificial Sequence
  Synthetic Oligonucleotide
uguauccuuuaguaaaauu

SEQ ID NO: 11453 - RNA, 19 nt, Artificial Sequence
  Synthetic Oligonucleotide
aucagcugggaagauauca

SEQ ID NO: 11454 - RNA, 19 nt, Artificial Sequence
  Synthetic Oligonucleotide
gugccagccacuauugaug

SEQ ID NO: 11455 - RNA, 19 nt, Artificial Sequence
  Synthetic Oligonucleotide
caggucuggggcaaaugau

SEQ ID NO: 11456 - RNA, 19 nt, Artificial Sequence
  Synthetic Oligonucleotide
gggugccagaaugugaaag

SEQ ID NO: 11457 - RNA, 19 nt, Artificial Sequence
  Synthetic Oligonucleotide
uggaagcuguauccaagga

SEQ ID NO: 11458 - RNA, 19 nt, Artificial Sequence
  Synthetic Oligonucleotide
ugagugggugccagaaugu

SEQ ID NO: 11459 - RNA, 19 nt, Artificial Sequence
  Synthetic Oligonucleotide
uuuccagauggaagcugua

SEQ ID NO: 11460 - RNA, 19 nt, Artificial Sequence
  Synthetic Oligonucleotide
aucuacaaggaccgagaag

SEQ ID NO: 11461 - RNA, 19 nt, Artificial Sequence
  Synthetic Oligonucleotide
aggaaaauuuuggagacga

SEQ ID NO: 11462 - RNA, 19 nt, Artificial Sequence
  Synthetic Oligonucleotide
gggugaccacagucuguaa

SEQ ID NO: 11463 - RNA, 19 nt, Artificial Sequence
  Synthetic Oligonucleotide
gacaaagagacacugugca

SEQ ID NO: 11464 - RNA, 19 nt, Artificial Sequence
  Synthetic Oligonucleotide
agguguucaagauguccuc

SEQ ID NO: 11465 - RNA, 19 nt, Artificial Sequence
  Synthetic Oligonucleotide
gcacuggagagaauuggaa

SEQ ID NO: 11466 - RNA, 19 nt, Artificial Sequence
  Synthetic Oligonucleotide
uacaugucuuuaaaacagu

SEQ ID NO: 11467 - RNA, 19 nt, Artificial Sequence
  Synthetic Oligonucleotide
gagaagucaccaagaagcu

SEQ ID NO: 11468 - RNA, 19 nt, Artificial Sequence
  Synthetic Oligonucleotide
ucuauauaugacuauuaca

SEQ ID NO: 11469 - RNA, 19 nt, Artificial Sequence
  Synthetic Oligonucleotide
cuauauaugacuauuacag

SEQ ID NO: 11470 - RNA, 19 nt, Artificial Sequence
  Synthetic Oligonucleotide
aaagggcauuuugagaggu

SEQ ID NO: 11471 - RNA, 19 nt, Artificial Sequence
  Synthetic Oligonucleotide
gaagauaucaaauggcuga

SEQ ID NO: 11472 - RNA, 19 nt, Artificial Sequence
  Synthetic Oligonucleotide
agauucaaacugccgccac

SEQ ID NO: 11473 - RNA, 19 nt, Artificial Sequence
  Synthetic Oligonucleotide
gaugcuccggaauguugcu

SEQ ID NO: 11474 - RNA, 19 nt, Artificial Sequence
  Synthetic Oligonucleotide
ugaggaaaauuuuggagac

SEQ ID NO: 11475 - RNA, 19 nt, Artificial Sequence
  Synthetic Oligonucleotide
acaaggaccgagaagucac

SEQ ID NO: 11476 - RNA, 19 nt, Artificial Sequence
  Synthetic Oligonucleotide
aaaugaugaagaaacuuug

SEQ ID NO: 11477 - RNA, 19 nt, Artificial Sequence
  Synthetic Oligonucleotide
aggcacugauguucugaaa

SEQ ID NO: 11478 - RNA, 19 nt, Artificial Sequence
  Synthetic Oligonucleotide
caaaugaugaagaaacuuu

SEQ ID NO: 11479 - RNA, 19 nt, Artificial Sequence
  Synthetic Oligonucleotide
ggguggcgguaauugguga

SEQ ID NO: 11480 - RNA, 19 nt, Artificial Sequence
  Synthetic Oligonucleotide
uggggcaaaugaugaagaa

SEQ ID NO: 11481 - RNA, 19 nt, Artificial Sequence
  Synthetic Oligonucleotide
auggguggcgguaauuggu

SEQ ID NO: 11482 - RNA, 19 nt, Artificial Sequence
  Synthetic Oligonucleotide
gucgacuucuguuuuagga

SEQ ID NO: 11483 - RNA, 19 nt, Artificial Sequence
  Synthetic Oligonucleotide
ugcaacuguauaucuacaa

SEQ ID NO: 11484 - RNA, 19 nt, Artificial Sequence
  Synthetic Oligonucleotide
auauguggcuaaagcaaua

SEQ ID NO: 11485 - RNA, 19 nt, Artificial Sequence
  Synthetic Oligonucleotide
cugccgccacaacucagga

SEQ ID NO: 11486 - RNA, 19 nt, Artificial Sequence
  Synthetic Oligonucleotide
uaucagcugggaagauauc

SEQ ID NO: 11487 - RNA, 19 nt, Artificial Sequence
  Synthetic Oligonucleotide
aaauuggagguagcaaaca

SEQ ID NO: 11488 - RNA, 19 nt, Artificial Sequence
  Synthetic Oligonucleotide
cauuggugaggaaaaaucc

SEQ ID NO: 11489 - RNA, 19 nt, Artificial Sequence
  Synthetic Oligonucleotide
aaagagacacugugcagag

SEQ ID NO: 11490 - RNA, 19 nt, Artificial Sequence
  Synthetic Oligonucleotide
accacagucuguaauuccc

SEQ ID NO: 11491 - RNA, 19 nt, Artificial Sequence
  Synthetic Oligonucleotide
gagaaagguguucaagaug

SEQ ID NO: 11492 - RNA, 19 nt, Artificial Sequence
  Synthetic Oligonucleotide
uugagaagguagcacugga

SEQ ID NO: 11493 - RNA, 19 nt, Artificial Sequence
  Synthetic Oligonucleotide
agggcauuuugagagguga

SEQ ID NO: 11494 - RNA, 19 nt, Artificial Sequence
  Synthetic Oligonucleotide
acaggucuggggcaaauga

SEQ ID NO: 11495 - RNA, 19 nt, Artificial Sequence
  Synthetic Oligonucleotide
uuuucuccugaggaaaauu

SEQ ID NO: 11496 - RNA, 19 nt, Artificial Sequence
  Synthetic Oligonucleotide
auccuuuaguaaaauugga

SEQ ID NO: 11497 - RNA, 19 nt, Artificial Sequence
  Synthetic Oligonucleotide
cuaucagcugggaagauau

SEQ ID NO: 11498 - RNA, 19 nt, Artificial Sequence
  Synthetic Oligonucleotide
gggccaccuccucaauuga

SEQ ID NO: 11499 - RNA, 19 nt, Artificial Sequence
  Synthetic Oligonucleotide
uacaaggaccgagaaguca

SEQ ID NO: 11500 - RNA, 19 nt, Artificial Sequence
  Synthetic Oligonucleotide
aauggguggcgguaauugg

SEQ ID NO: 11501 - RNA, 19 nt, Artificial Sequence
  Synthetic Oligonucleotide
gcuacaaggccauauuugu

SEQ ID NO: 11502 - RNA, 19 nt, Artificial Sequence
  Synthetic Oligonucleotide
uucuccugaggaaaauuuu

SEQ ID NO: 11503 - RNA, 19 nt, Artificial Sequence
  Synthetic Oligonucleotide
gaccgagaagucaccaaga

SEQ ID NO: 11504 - RNA, 19 nt, Artificial Sequence
  Synthetic Oligonucleotide
guguccuaggaaccuuuua

SEQ ID NO: 11505 - RNA, 19 nt, Artificial Sequence
  Synthetic Oligonucleotide
cgagaagucaccaagaagc

SEQ ID NO: 11506 - RNA, 19 nt, Artificial Sequence
  Synthetic Oligonucleotide
ucgagauacuaaaggaaga

SEQ ID NO: 11507 - RNA, 19 nt, Artificial Sequence
  Synthetic Oligonucleotide
agacgacaguggacuugcu

SEQ ID NO: 11508 - RNA, 19 nt, Artificial Sequence
  Synthetic Oligonucleotide
gacccaucuaucagcuggg

SEQ ID NO: 11509 - RNA, 19 nt, Artificial Sequence
  Synthetic Oligonucleotide
cugagugggugccagaaug

SEQ ID NO: 11510 - RNA, 19 nt, Artificial Sequence
  Synthetic Oligonucleotide
caaagagacacugugcaga

SEQ ID NO: 11511 - RNA, 19 nt, Artificial Sequence
  Synthetic Oligonucleotide
gcugcauauguggcuaaag

SEQ ID NO: 11512 - RNA, 19 nt, Artificial Sequence
  Synthetic Oligonucleotide
uucuuagagagaaauaaag

SEQ ID NO: 11513 - RNA, 19 nt, Artificial Sequence
  Synthetic Oligonucleotide
caauggguguccuaggaac

SEQ ID NO: 11514 - RNA, 19 nt, Artificial Sequence
  Synthetic Oligonucleotide
ccaucuaucagcugggaag

SEQ ID NO: 11515 - RNA, 19 nt, Artificial Sequence
  Synthetic Oligonucleotide
uauauaugacuauuacagg

SEQ ID NO: 11516 - RNA, 19 nt, Artificial Sequence
  Synthetic Oligonucleotide
aggucuggggcaaaugaug

SEQ ID NO: 11517 - RNA, 19 nt, Artificial Sequence
  Synthetic Oligonucleotide
auagacccaucuaucagcu

SEQ ID NO: 11518 - RNA, 19 nt, Artificial Sequence
  Synthetic Oligonucleotide
ugccaauuguugcaaaggg

SEQ ID NO: 11519 - RNA, 19 nt, Artificial Sequence
  Synthetic Oligonucleotide
auguccucgagauacuaaa

SEQ ID NO: 11520 - RNA, 19 nt, Artificial Sequence
  Synthetic Oligonucleotide
guugcaaagggcauuuuga

SEQ ID NO: 11521 - RNA, 19 nt, Artificial Sequence
  Synthetic Oligonucleotide
gugcggaaaggcacugaug

SEQ ID NO: 11522 - RNA, 19 nt, Artificial Sequence
  Synthetic Oligonucleotide
uccggaauguugcugaaac

SEQ ID NO: 11523 - RNA, 19 nt, Artificial Sequence
  Synthetic Oligonucleotide
guagcacuggagagaauug

SEQ ID NO: 11524 - RNA, 19 nt, Artificial Sequence
  Synthetic Oligonucleotide
acaguggacuugcugcaua

SEQ ID NO: 11525 - RNA, 19 nt, Artificial Sequence
  Synthetic Oligonucleotide
aguggacuugcugcauaug

SEQ ID NO: 11526 - RNA, 19 nt, Artificial Sequence
  Synthetic Oligonucleotide
aggcacuucguuggcugca

SEQ ID NO: 11527 - RNA, 19 nt, Artificial Sequence
  Synthetic Oligonucleotide
uuccaaucacaucuuuagu

SEQ ID NO: 11528 - RNA, 19 nt, Artificial Sequence
  Synthetic Oligonucleotide
uuuuggagacgacagugga

SEQ ID NO: 11529 - RNA, 19 nt, Artificial Sequence
  Synthetic Oligonucleotide
uccuuuaguaaaauuggag

SEQ ID NO: 11530 - RNA, 19 nt, Artificial Sequence
  Synthetic Oligonucleotide
ugaaugggaucuugguguc

SEQ ID NO: 11531 - RNA, 19 nt, Artificial Sequence
  Synthetic Oligonucleotide
acugauguucugaaagcuc

SEQ ID NO: 11532 - RNA, 19 nt, Artificial Sequence
  Synthetic Oligonucleotide
cuugccacugugagagccu

SEQ ID NO: 11533 - RNA, 19 nt, Artificial Sequence
  Synthetic Oligonucleotide
aaaauuuuggagacgacag

SEQ ID NO: 11534 - RNA, 19 nt, Artificial Sequence
  Synthetic Oligonucleotide
gugaccacagucuguaauu

SEQ ID NO: 11535 - RNA, 19 nt, Artificial Sequence
  Synthetic Oligonucleotide
ggacagagggucagcaugc

SEQ ID NO: 11536 - RNA, 19 nt, Artificial Sequence
  Synthetic Oligonucleotide
guggcgguaauuggugaua

SEQ ID NO: 11537 - RNA, 19 nt, Artificial Sequence
  Synthetic Oligonucleotide
gcauuuugagaggugauga

SEQ ID NO: 11538 - RNA, 19 nt, Artificial Sequence
  Synthetic Oligonucleotide
ggaagcuguauccaaggau

SEQ ID NO: 11539 - RNA, 19 nt, Artificial Sequence
  Synthetic Oligonucleotide
uagcacuggagagaauugg

SEQ ID NO: 11540 - RNA, 19 nt, Artificial Sequence
  Synthetic Oligonucleotide
accgagaagucaccaagaa

SEQ ID NO: 11541 - RNA, 19 nt, Artificial Sequence
  Synthetic Oligonucleotide
cccaucuaucagcugggaa

SEQ ID NO: 11542 - RNA, 19 nt, Artificial Sequence
  Synthetic Oligonucleotide
ggaggcuguuaaacauggc

SEQ ID NO: 11543 - RNA, 19 nt, Artificial Sequence
  Synthetic Oligonucleotide
aggaccgagaagucaccaa

SEQ ID NO: 11544 - RNA, 19 nt, Artificial Sequence
  Synthetic Oligonucleotide
ugggaagauaucaaauggc

SEQ ID NO: 11545 - RNA, 19 nt, Artificial Sequence
  Synthetic Oligonucleotide
ucagcugggaagauaucaa

SEQ ID NO: 11546 - RNA, 19 nt, Artificial Sequence
  Synthetic Oligonucleotide
uaaacauggcuugaauggg

SEQ ID NO: 11547 - RNA, 19 nt, Artificial Sequence
  Synthetic Oligonucleotide
gaaaauuuuggagacgaca

SEQ ID NO: 11548 - RNA, 19 nt, Artificial Sequence
  Synthetic Oligonucleotide
ggagaaagguguucaagau

SEQ ID NO: 11549 - RNA, 19 nt, Artificial Sequence
  Synthetic Oligonucleotide
ugcaaagggcauuuugaga

SEQ ID NO: 11550 - RNA, 19 nt, Artificial Sequence
  Synthetic Oligonucleotide
uuguugcaaagggcauuuu

SEQ ID NO: 11551 - RNA, 19 nt, Artificial Sequence
  Synthetic Oligonucleotide
uuuccaacaaaauagcaau

SEQ ID NO: 11552 - RNA, 19 nt, Artificial Sequence
  Synthetic Oligonucleotide
uuccccacuucaauacaaa

SEQ ID NO: 11553 - RNA, 19 nt, Artificial Sequence
  Synthetic Oligonucleotide
acuauuacaggucuggggc

SEQ ID NO: 11554 - RNA, 19 nt, Artificial Sequence
  Synthetic Oligonucleotide
aaauuguggaggcugugga

SEQ ID NO: 11555 - RNA, 19 nt, Artificial Sequence
  Synthetic Oligonucleotide
ugcagagggugaccacagu

SEQ ID NO: 11556 - RNA, 19 nt, Artificial Sequence
  Synthetic Oligonucleotide
cauugccaauuguugcaaa

SEQ ID NO: 11557 - RNA, 19 nt, Artificial Sequence
  Synthetic Oligonucleotide
auccaaggaugcuccggaa

SEQ ID NO: 11558 - RNA, 19 nt, Artificial Sequence
  Synthetic Oligonucleotide
gauacuaaaggaagaauuc

SEQ ID NO: 11559 - RNA, 19 nt, Artificial Sequence
  Synthetic Oligonucleotide
gagacacugugcagagggu

SEQ ID NO: 11560 - RNA, 19 nt, Artificial Sequence
  Synthetic Oligonucleotide
aaauuuuggagacgacagu

SEQ ID NO: 11561 - RNA, 19 nt, Artificial Sequence
  Synthetic Oligonucleotide
ucugucgacuucuguuuua

SEQ ID NO: 11562 - RNA, 19 nt, Artificial Sequence
  Synthetic Oligonucleotide
ugaccacagucuguaauuc

SEQ ID NO: 11563 - RNA, 19 nt, Artificial Sequence
  Synthetic Oligonucleotide
cugugcagagggugaccac

SEQ ID NO: 11564 - RNA, 19 nt, Artificial Sequence
  Synthetic Oligonucleotide
ucaauggguguccuaggaa

SEQ ID NO: 11565 - RNA, 19 nt, Artificial Sequence
  Synthetic Oligonucleotide
uuucaauggguguccuagg

SEQ ID NO: 11566 - RNA, 19 nt, Artificial Sequence
  Synthetic Oligonucleotide
gugugcggaaaggcacuga

SEQ ID NO: 11567 - RNA, 19 nt, Artificial Sequence
  Synthetic Oligonucleotide
uguggcuaaagcaauagac

SEQ ID NO: 11568 - RNA, 19 nt, Artificial Sequence
  Synthetic Oligonucleotide
gacuucuguuuuaggacag

SEQ ID NO: 11569 - RNA, 19 nt, Artificial Sequence
  Synthetic Oligonucleotide
auuuccaaucacaucuuua

SEQ ID NO: 11570 - RNA, 19 nt, Artificial Sequence
  Synthetic Oligonucleotide
uguccucgagauacuaaag

SEQ ID NO: 11571 - RNA, 19 nt, Artificial Sequence
  Synthetic Oligonucleotide
gcaaagggcauuuugagag

SEQ ID NO: 11572 - RNA, 19 nt, Artificial Sequence
  Synthetic Oligonucleotide
auacuaaaggaagaauucc

SEQ ID NO: 11573 - RNA, 19 nt, Artificial Sequence
  Synthetic Oligonucleotide
cuugaaugggaucuuggug

SEQ ID NO: 11574 - RNA, 19 nt, Artificial Sequence
  Synthetic Oligonucleotide
uguuuuaggacagaggguc

SEQ ID NO: 11575 - RNA, 19 nt, Artificial Sequence
  Synthetic Oligonucleotide
gggaacgggcaugauguug

SEQ ID NO: 11576 - RNA, 19 nt, Artificial Sequence
  Synthetic Oligonucleotide
ucuacaaggaccgagaagu

SEQ ID NO: 11577 - RNA, 19 nt, Artificial Sequence
  Synthetic Oligonucleotide
uccugaggaaaauuuugga

SEQ ID NO: 11578 - RNA, 19 nt, Artificial Sequence
  Synthetic Oligonucleotide
gcuguuaaacauggcuuga

SEQ ID NO: 11579 - RNA, 19 nt, Artificial Sequence
  Synthetic Oligonucleotide
auggggugccagccacuau

SEQ ID NO: 11580 - RNA, 19 nt, Artificial Sequence
  Synthetic Oligonucleotide
augggcuacaaggccauau

SEQ ID NO: 11581 - RNA, 19 nt, Artificial Sequence
  Synthetic Oligonucleotide
cuguuaaacauggcuugaa

SEQ ID NO: 11582 - RNA, 19 nt, Artificial Sequence
  Synthetic Oligonucleotide
ggcauuuugagaggugaug

SEQ ID NO: 11583 - RNA, 19 nt, Artificial Sequence
  Synthetic Oligonucleotide
aauuuuggagacgacagug

SEQ ID NO: 11584 - RNA, 19 nt, Artificial Sequence
  Synthetic Oligonucleotide
ugggugccagaaugugaaa

SEQ ID NO: 11585 - RNA, 19 nt, Artificial Sequence
  Synthetic Oligonucleotide
aaccgucuggaugaugugc

SEQ ID NO: 11586 - RNA, 19 nt, Artificial Sequence
  Synthetic Oligonucleotide
gcaauagacccaucuauca

SEQ ID NO: 11587 - RNA, 19 nt, Artificial Sequence
  Synthetic Oligonucleotide
uggacuugcugcauaugug

SEQ ID NO: 11588 - RNA, 19 nt, Artificial Sequence
  Synthetic Oligonucleotide
auugccaauuguugcaaag

SEQ ID NO: 11589 - RNA, 19 nt, Artificial Sequence
  Synthetic Oligonucleotide
cuauuacaggucuggggca

SEQ ID NO: 11590 - RNA, 19 nt, Artificial Sequence
  Synthetic Oligonucleotide
ccaaggaugcuccggaaug

SEQ ID NO: 11591 - RNA, 19 nt, Artificial Sequence
  Synthetic Oligonucleotide
ccagaaauuguggaggcug

SEQ ID NO: 11592 - RNA, 19 nt, Artificial Sequence
  Synthetic Oligonucleotide
uacaaggccauauuuguga

SEQ ID NO: 11593 - RNA, 19 nt, Artificial Sequence
  Synthetic Oligonucleotide
gaauggguggcgguaauug

SEQ ID NO: 11594 - RNA, 19 nt, Artificial Sequence
  Synthetic Oligonucleotide
cgauggggugccagccacu

SEQ ID NO: 11595 - RNA, 19 nt, Artificial Sequence
  Synthetic Oligonucleotide
aaacauggcuugaauggga

SEQ ID NO: 11596 - RNA, 19 nt, Artificial Sequence
  Synthetic Oligonucleotide
ccccacuucaauacaaagg

SEQ ID NO: 11597 - RNA, 19 nt, Artificial Sequence
  Synthetic Oligonucleotide
uguuuacaugucuuuaaaa

SEQ ID NO: 11598 - RNA, 19 nt, Artificial Sequence
  Synthetic Oligonucleotide
cugauguucugaaagcucu

SEQ ID NO: 11599 - RNA, 19 nt, Artificial Sequence
  Synthetic Oligonucleotide
ucugagugggugccagaau

SEQ ID NO: 11600 - RNA, 19 nt, Artificial Sequence
  Synthetic Oligonucleotide
uugacaaagagacacugug

SEQ ID NO: 11601 - RNA, 19 nt, Artificial Sequence
  Synthetic Oligonucleotide
ucgacuucuguuuuaggac

SEQ ID NO: 11602 - RNA, 19 nt, Artificial Sequence
  Synthetic Oligonucleotide
ggagacgacaguggacuug

SEQ ID NO: 11603 - RNA, 19 nt, Artificial Sequence
  Synthetic Oligonucleotide
gggcauuuugagaggugau

SEQ ID NO: 11604 - RNA, 19 nt, Artificial Sequence
  Synthetic Oligonucleotide
caacuuugagaagguagca

SEQ ID NO: 11605 - RNA, 19 nt, Artificial Sequence
  Synthetic Oligonucleotide
gggcuacaaggccauauuu

SEQ ID NO: 11606 - RNA, 19 nt, Artificial Sequence
  Synthetic Oligonucleotide
ggccaccuccucaauugaa

SEQ ID NO: 11607 - RNA, 19 nt, Artificial Sequence
  Synthetic Oligonucleotide
guuuccaagaucugacagu

SEQ ID NO: 11608 - RNA, 19 nt, Artificial Sequence
  Synthetic Oligonucleotide
ggcaaaugaugaagaaacu

SEQ ID NO: 11609 - RNA, 19 nt, Artificial Sequence
  Synthetic Oligonucleotide
augggaucuuggugucgaa

SEQ ID NO: 11610 - RNA, 19 nt, Artificial Sequence
  Synthetic Oligonucleotide
cguaacagauucaaacugc

SEQ ID NO: 11611 - RNA, 19 nt, Artificial Sequence
  Synthetic Oligonucleotide
ugggcuacaaggccauauu

SEQ ID NO: 11612 - RNA, 19 nt, Artificial Sequence
  Synthetic Oligonucleotide
ggaacgggcaugauguuga

SEQ ID NO: 11613 - RNA, 19 nt, Artificial Sequence
  Synthetic Oligonucleotide
cuguuuuaggacagagggu

SEQ ID NO: 11614 - RNA, 19 nt, Artificial Sequence
  Synthetic Oligonucleotide
acugccgccacaacucagg

SEQ ID NO: 11615 - RNA, 19 nt, Artificial Sequence
  Synthetic Oligonucleotide
gaagaugggcuacaaggcc

SEQ ID NO: 11616 - RNA, 19 nt, Artificial Sequence
  Synthetic Oligonucleotide
acagauucaaacugccgcc

SEQ ID NO: 11617 - RNA, 19 nt, Artificial Sequence
  Synthetic Oligonucleotide
uccaaggaugcuccggaau

SEQ ID NO: 11618 - RNA, 19 nt, Artificial Sequence
  Synthetic Oligonucleotide
uccagauggaagcuguauc

SEQ ID NO: 11619 - RNA, 19 nt, Artificial Sequence
  Synthetic Oligonucleotide
agcuguauccaaggaugcu

SEQ ID NO: 11620 - RNA, 19 nt, Artificial Sequence
  Synthetic Oligonucleotide
gauggggugccagccacua

SEQ ID NO: 11621 - RNA, 19 nt, Artificial Sequence
  Synthetic Oligonucleotide
uuggagacgacaguggacu

SEQ ID NO: 11622 - RNA, 19 nt, Artificial Sequence
  Synthetic Oligonucleotide
uuaaacauggcuugaaugg

SEQ ID NO: 11623 - RNA, 19 nt, Artificial Sequence
  Synthetic Oligonucleotide
gcacuucguuggcugcaac

SEQ ID NO: 11624 - RNA, 19 nt, Artificial Sequence
  Synthetic Oligonucleotide
ggcuugaaugggaucuugg

SEQ ID NO: 11625 - RNA, 19 nt, Artificial Sequence
  Synthetic Oligonucleotide
agcugggaagauaucaaau

SEQ ID NO: 11626 - RNA, 19 nt, Artificial Sequence
  Synthetic Oligonucleotide
uuccagauggaagcuguau

SEQ ID NO: 11627 - RNA, 19 nt, Artificial Sequence
  Synthetic Oligonucleotide
caauagacccaucuaucag

SEQ ID NO: 11628 - RNA, 19 nt, Artificial Sequence
  Synthetic Oligonucleotide
uuuccaagaucugacagug

SEQ ID NO: 11629 - RNA, 19 nt, Artificial Sequence
  Synthetic Oligonucleotide
acuuugagaagguagcacu

SEQ ID NO: 11630 - RNA, 19 nt, Artificial Sequence
  Synthetic Oligonucleotide
gccacugugagagccuguc

SEQ ID NO: 11631 - RNA, 19 nt, Artificial Sequence
  Synthetic Oligonucleotide
cauggcuugaaugggaucu

SEQ ID NO: 11632 - RNA, 19 nt, Artificial Sequence
  Synthetic Oligonucleotide
cugggaagauaucaaaugg

SEQ ID NO: 11633 - RNA, 19 nt, Artificial Sequence
  Synthetic Oligonucleotide
uugaaugggaucuuggugu

SEQ ID NO: 11634 - RNA, 19 nt, Artificial Sequence
  Synthetic Oligonucleotide
aauagacccaucuaucagc

SEQ ID NO: 11635 - RNA, 19 nt, Artificial Sequence
  Synthetic Oligonucleotide
uugacuuuucaaugggugu

SEQ ID NO: 11636 - RNA, 19 nt, Artificial Sequence
  Synthetic Oligonucleotide
cuaaaggaagaauuccggu

SEQ ID NO: 11637 - RNA, 19 nt, Artificial Sequence
  Synthetic Oligonucleotide
ugccgccacaacucaggau

SEQ ID NO: 11638 - RNA, 19 nt, Artificial Sequence
  Synthetic Oligonucleotide
ugugcguaacagauucaaa

SEQ ID NO: 11639 - RNA, 19 nt, Artificial Sequence
  Synthetic Oligonucleotide
gcaaaugaugaagaaacuu

SEQ ID NO: 11640 - RNA, 19 nt, Artificial Sequence
  Synthetic Oligonucleotide
aacgggcaugauguugagu

SEQ ID NO: 11641 - RNA, 19 nt, Artificial Sequence
  Synthetic Oligonucleotide
gcuugaaugggaucuuggu

SEQ ID NO: 11642 - RNA, 19 nt, Artificial Sequence
  Synthetic Oligonucleotide
auuggugaggaaaaauccu

SEQ ID NO: 11643 - RNA, 19 nt, Artificial Sequence
  Synthetic Oligonucleotide
cgaaucauggggcucgaca

SEQ ID NO: 11644 - RNA, 19 nt, Artificial Sequence
  Synthetic Oligonucleotide
agaugggcuacaaggccau

SEQ ID NO: 11645 - RNA, 19 nt, Artificial Sequence
  Synthetic Oligonucleotide
gugcguaacagauucaaac

SEQ ID NO: 11646 - RNA, 19 nt, Artificial Sequence
  Synthetic Oligonucleotide
cuuugagaagguagcacug

SEQ ID NO: 11647 - RNA, 19 nt, Artificial Sequence
  Synthetic Oligonucleotide
auuacaggucuggggcaaa

SEQ ID NO: 11648 - RNA, 19 nt, Artificial Sequence
  Synthetic Oligonucleotide
ugacuuuucaauggguguc

SEQ ID NO: 11649 - RNA, 19 nt, Artificial Sequence
  Synthetic Oligonucleotide
cacugugcagagggugacc

SEQ ID NO: 11650 - RNA, 19 nt, Artificial Sequence
  Synthetic Oligonucleotide
gaaauuguggaggcugugg

SEQ ID NO: 11651 - RNA, 19 nt, Artificial Sequence
  Synthetic Oligonucleotide
uugccaauuguugcaaagg

SEQ ID NO: 11652 - RNA, 19 nt, Artificial Sequence
  Synthetic Oligonucleotide
cuguggaagggaaggugga

SEQ ID NO: 11653 - RNA, 19 nt, Artificial Sequence
  Synthetic Oligonucleotide
gcuugccacugugagagcc

SEQ ID NO: 11654 - RNA, 19 nt, Artificial Sequence
  Synthetic Oligonucleotide
guuuuaggacagaggguca

SEQ ID NO: 11655 - RNA, 19 nt, Artificial Sequence
  Synthetic Oligonucleotide
gaagggaagguggaagucu

SEQ ID NO: 11656 - RNA, 19 nt, Artificial Sequence
  Synthetic Oligonucleotide
gggcaaaugaugaagaaac

SEQ ID NO: 11657 - RNA, 19 nt, Artificial Sequence
  Synthetic Oligonucleotide
aacugccgccacaacucag

SEQ ID NO: 11658 - RNA, 19 nt, Artificial Sequence
  Synthetic Oligonucleotide
aagcuguauccaaggaugc

SEQ ID NO: 11659 - RNA, 19 nt, Artificial Sequence
  Synthetic Oligonucleotide
uuaggacagagggucagca

SEQ ID NO: 11660 - RNA, 19 nt, Artificial Sequence
  Synthetic Oligonucleotide
ggacuugcugcauaugugg

SEQ ID NO: 11661 - RNA, 19 nt, Artificial Sequence
  Synthetic Oligonucleotide
cucugagugggugccagaa

SEQ ID NO: 11662 - RNA, 19 nt, Artificial Sequence
  Synthetic Oligonucleotide
auauaugacuauuacaggu

SEQ ID NO: 11663 - RNA, 19 nt, Artificial Sequence
  Synthetic Oligonucleotide
uaacagauucaaacugccg

SEQ ID NO: 11664 - RNA, 19 nt, Artificial Sequence
  Synthetic Oligonucleotide
uuuccaaucacaucuuuag

SEQ ID NO: 11665 - RNA, 19 nt, Artificial Sequence
  Synthetic Oligonucleotide
aagagacacugugcagagg

SEQ ID NO: 11666 - RNA, 19 nt, Artificial Sequence
  Synthetic Oligonucleotide
guggaagggaagguggaag

SEQ ID NO: 11667 - RNA, 19 nt, Artificial Sequence
  Synthetic Oligonucleotide
ccgagaagucaccaagaag

SEQ ID NO: 11668 - RNA, 19 nt, Artificial Sequence
  Synthetic Oligonucleotide
ggcaaccgucuggaugaug

SEQ ID NO: 11669 - RNA, 19 nt, Artificial Sequence
  Synthetic Oligonucleotide
gcaggcuaaagugcuguau

SEQ ID NO: 11670 - RNA, 19 nt, Artificial Sequence
  Synthetic Oligonucleotide
gaggcuguuaaacauggcu

SEQ ID NO: 11671 - RNA, 19 nt, Artificial Sequence
  Synthetic Oligonucleotide
agaauuggaauggguggcg

SEQ ID NO: 11672 - RNA, 19 nt, Artificial Sequence
  Synthetic Oligonucleotide
cuuuucaauggguguccua

SEQ ID NO: 11673 - RNA, 19 nt, Artificial Sequence
  Synthetic Oligonucleotide
gaugccagggaggcuguua

SEQ ID NO: 11674 - RNA, 19 nt, Artificial Sequence
  Synthetic Oligonucleotide
gauucaaacugccgccaca

SEQ ID NO: 11675 - RNA, 19 nt, Artificial Sequence
  Synthetic Oligonucleotide
aggacagagggucagcaug

SEQ ID NO: 11676 - RNA, 19 nt, Artificial Sequence
  Synthetic Oligonucleotide
gacacugugcagaggguga

SEQ ID NO: 11677 - RNA, 19 nt, Artificial Sequence
  Synthetic Oligonucleotide
ggugucgaaucauggggcu

SEQ ID NO: 11678 - RNA, 19 nt, Artificial Sequence
  Synthetic Oligonucleotide
uagacccaucuaucagcug

SEQ ID NO: 11679 - RNA, 19 nt, Artificial Sequence
  Synthetic Oligonucleotide
auggcuugaaugggaucuu

SEQ ID NO: 11680 - RNA, 19 nt, Artificial Sequence
  Synthetic Oligonucleotide
caaacugccgccacaacuc

SEQ ID NO: 11681 - RNA, 19 nt, Artificial Sequence
  Synthetic Oligonucleotide
augaugccagggaggcugu

SEQ ID NO: 11682 - RNA, 19 nt, Artificial Sequence
  Synthetic Oligonucleotide
cugggccaccuccucaauu

SEQ ID NO: 11683 - RNA, 19 nt, Artificial Sequence
  Synthetic Oligonucleotide
auguucugaaagcucuggc

SEQ ID NO: 11684 - RNA, 19 nt, Artificial Sequence
  Synthetic Oligonucleotide
uauuacaggucuggggcaa

SEQ ID NO: 11685 - RNA, 19 nt, Artificial Sequence
  Synthetic Oligonucleotide
uggggugccagccacuauu

SEQ ID NO: 11686 - RNA, 19 nt, Artificial Sequence
  Synthetic Oligonucleotide
cgacuucuguuuuaggaca

SEQ ID NO: 11687 - RNA, 19 nt, Artificial Sequence
  Synthetic Oligonucleotide
acacugugcagagggugac

SEQ ID NO: 11688 - RNA, 19 nt, Artificial Sequence
  Synthetic Oligonucleotide
uaggacagagggucagcau

SEQ ID NO: 11689 - RNA, 19 nt, Artificial Sequence
  Synthetic Oligonucleotide
ggaagggaagguggaaguc

SEQ ID NO: 11690 - RNA, 19 nt, Artificial Sequence
  Synthetic Oligonucleotide
ggcacugauguucugaaag

SEQ ID NO: 11691 - RNA, 19 nt, Artificial Sequence
  Synthetic Oligonucleotide
uacaggucuggggcaaaug

SEQ ID NO: 11692 - RNA, 19 nt, Artificial Sequence
  Synthetic Oligonucleotide
gaauuggaauggguggcgg

SEQ ID NO: 11693 - RNA, 19 nt, Artificial Sequence
  Synthetic Oligonucleotide
uaucuacaaggaccgagaa

SEQ ID NO: 11694 - RNA, 19 nt, Artificial Sequence
  Synthetic Oligonucleotide
cagauucaaacugccgcca

SEQ ID NO: 11695 - RNA, 19 nt, Artificial Sequence
  Synthetic Oligonucleotide
gucuggggcaaaugaugaa

SEQ ID NO: 11696 - RNA, 19 nt, Artificial Sequence
  Synthetic Oligonucleotide
gcaaccgucuggaugaugu

SEQ ID NO: 11697 - RNA, 19 nt, Artificial Sequence
  Synthetic Oligonucleotide
uuacaggucuggggcaaau

SEQ ID NO: 11698 - RNA, 19 nt, Artificial Sequence
  Synthetic Oligonucleotide
ggggcaaaugaugaagaaa

SEQ ID NO: 11699 - RNA, 19 nt, Artificial Sequence
  Synthetic Oligonucleotide
aagaugggcuacaaggcca

SEQ ID NO: 11700 - RNA, 19 nt, Artificial Sequence
  Synthetic Oligonucleotide
uggagacgacaguggacuu

SEQ ID NO: 11701 - RNA, 19 nt, Artificial Sequence
  Synthetic Oligonucleotide
uuuugagaggugaugaugc

SEQ ID NO: 11702 - RNA, 19 nt, Artificial Sequence
  Synthetic Oligonucleotide
agaagucaccaagaagcua

SEQ ID NO: 11703 - RNA, 19 nt, Artificial Sequence
  Synthetic Oligonucleotide
gaacgggcaugauguugag

SEQ ID NO: 11704 - RNA, 19 nt, Artificial Sequence
  Synthetic Oligonucleotide
auuggaauggguggcggua

SEQ ID NO: 11705 - RNA, 19 nt, Artificial Sequence
  Synthetic Oligonucleotide
guucugccagaaauugugg

SEQ ID NO: 11706 - RNA, 19 nt, Artificial Sequence
  Synthetic Oligonucleotide
gcuguggaagggaaggugg

SEQ ID NO: 11707 - RNA, 19 nt, Artificial Sequence
  Synthetic Oligonucleotide
gaccaaucguuuggggcuu

SEQ ID NO: 11708 - RNA, 19 nt, Artificial Sequence
  Synthetic Oligonucleotide
aaacugccgccacaacuca

SEQ ID NO: 11709 - RNA, 19 nt, Artificial Sequence
  Synthetic Oligonucleotide
ucuggggcaaaugaugaag

SEQ ID NO: 11710 - RNA, 19 nt, Artificial Sequence
  Synthetic Oligonucleotide
caauugaagaaguggcgga

SEQ ID NO: 11711 - RNA, 19 nt, Artificial Sequence
  Synthetic Oligonucleotide
aggcuaaagugcuguaucc

SEQ ID NO: 11712 - RNA, 19 nt, Artificial Sequence
  Synthetic Oligonucleotide
gcugggaagauaucaaaug

SEQ ID NO: 11713 - RNA, 19 nt, Artificial Sequence
  Synthetic Oligonucleotide
gcuguauccaaggaugcuc

SEQ ID NO: 11714 - RNA, 19 nt, Artificial Sequence
  Synthetic Oligonucleotide
agcuugccacugugagagc

SEQ ID NO: 11715 - RNA, 19 nt, Artificial Sequence
  Synthetic Oligonucleotide
cugggaacgggcaugaugu

SEQ ID NO: 11716 - RNA, 19 nt, Artificial Sequence
  Synthetic Oligonucleotide
ggaauggguggcgguaauu

SEQ ID NO: 11717 - RNA, 19 nt, Artificial Sequence
  Synthetic Oligonucleotide
gugaugaugccagggaggc

SEQ ID NO: 11718 - RNA, 19 nt, Artificial Sequence
  Synthetic Oligonucleotide
guuuagacaacgucauccc

SEQ ID NO: 11719 - RNA, 19 nt, Artificial Sequence
  Synthetic Oligonucleotide
uuuggagacgacaguggac

SEQ ID NO: 11720 - RNA, 19 nt, Artificial Sequence
  Synthetic Oligonucleotide
cauuuugagaggugaugau

SEQ ID NO: 11721 - RNA, 19 nt, Artificial Sequence
  Synthetic Oligonucleotide
gaugggcuacaaggccaua

SEQ ID NO: 11722 - RNA, 19 nt, Artificial Sequence
  Synthetic Oligonucleotide
uacuaaaggaagaauuccg

SEQ ID NO: 11723 - RNA, 19 nt, Artificial Sequence
  Synthetic Oligonucleotide
uuugagaggugaugaugcc

SEQ ID NO: 11724 - RNA, 19 nt, Artificial Sequence
  Synthetic Oligonucleotide
gcacugauguucugaaagc

SEQ ID NO: 11725 - RNA, 19 nt, Artificial Sequence
  Synthetic Oligonucleotide
gggaggcuguuaaacaugg

SEQ ID NO: 11726 - RNA, 19 nt, Artificial Sequence
  Synthetic Oligonucleotide
ucuguuuuaggacagaggg

SEQ ID NO: 11727 - RNA, 19 nt, Artificial Sequence
  Synthetic Oligonucleotide
aacagauucaaacugccgc

SEQ ID NO: 11728 - RNA, 19 nt, Artificial Sequence
  Synthetic Oligonucleotide
gccagaaauuguggaggcu

SEQ ID NO: 11729 - RNA, 19 nt, Artificial Sequence
  Synthetic Oligonucleotide
caaccgucuggaugaugug

SEQ ID NO: 11730 - RNA, 19 nt, Artificial Sequence
  Synthetic Oligonucleotide
agaagaugggcuacaaggc

SEQ ID NO: 11731 - RNA, 19 nt, Artificial Sequence
  Synthetic Oligonucleotide
agacccaucuaucagcugg

SEQ ID NO: 11732 - RNA, 19 nt, Artificial Sequence
  Synthetic Oligonucleotide
gcucugagugggugccaga

SEQ ID NO: 11733 - RNA, 19 nt, Artificial Sequence
  Synthetic Oligonucleotide
cguuuccaagaucugacag

SEQ ID NO: 11734 - RNA, 19 nt, Artificial Sequence
  Synthetic Oligonucleotide
ggugugcggaaaggcacug

SEQ ID NO: 11735 - RNA, 19 nt, Artificial Sequence
  Synthetic Oligonucleotide
aauugaagaaguggcggaa

SEQ ID NO: 11736 - RNA, 19 nt, Artificial Sequence
  Synthetic Oligonucleotide
ugggccaccuccucaauug

SEQ ID NO: 11737 - RNA, 19 nt, Artificial Sequence
  Synthetic Oligonucleotide
cuccucaauugaagaagug

SEQ ID NO: 11738 - RNA, 19 nt, Artificial Sequence
  Synthetic Oligonucleotide
guuaaacauggcuugaaug

SEQ ID NO: 11739 - RNA, 19 nt, Artificial Sequence
  Synthetic Oligonucleotide
gccguuuccaagaucugac

SEQ ID NO: 11740 - RNA, 19 nt, Artificial Sequence
  Synthetic Oligonucleotide
cucaauugaagaaguggcg

SEQ ID NO: 11741 - RNA, 19 nt, Artificial Sequence
  Synthetic Oligonucleotide
uauaugacuauuacagguc

SEQ ID NO: 11742 - RNA, 19 nt, Artificial Sequence
  Synthetic Oligonucleotide
cacuucguuggcugcaacu

SEQ ID NO: 11743 - RNA, 19 nt, Artificial Sequence
  Synthetic Oligonucleotide
ccugggccaccuccucaau

SEQ ID NO: 11744 - RNA, 19 nt, Artificial Sequence
  Synthetic Oligonucleotide
cuguauccaaggaugcucc

SEQ ID NO: 11745 - RNA, 19 nt, Artificial Sequence
  Synthetic Oligonucleotide
aacauggcuugaaugggau

SEQ ID NO: 11746 - RNA, 19 nt, Artificial Sequence
  Synthetic Oligonucleotide
acugugcagagggugacca

SEQ ID NO: 11747 - RNA, 19 nt, Artificial Sequence
  Synthetic Oligonucleotide
ggaaaaauccuuuggccgu

SEQ ID NO: 11748 - RNA, 19 nt, Artificial Sequence
  Synthetic Oligonucleotide
gagaauuggaauggguggc

SEQ ID NO: 11749 - RNA, 19 nt, Artificial Sequence
  Synthetic Oligonucleotide
aagaaguggcggaagcugg

SEQ ID NO: 11750 - RNA, 19 nt, Artificial Sequence
  Synthetic Oligonucleotide
uccccacuucaauacaaag

SEQ ID NO: 11751 - RNA, 19 nt, Artificial Sequence
  Synthetic Oligonucleotide
acuaaaggaagaauuccgg

SEQ ID NO: 11752 - RNA, 19 nt, Artificial Sequence
  Synthetic Oligonucleotide
uggaagggaagguggaagu

SEQ ID NO: 11753 - RNA, 19 nt, Artificial Sequence
  Synthetic Oligonucleotide
ugacuauuacaggucuggg

SEQ ID NO: 11754 - RNA, 19 nt, Artificial Sequence
  Synthetic Oligonucleotide
ccacugugagagccuguca

SEQ ID NO: 11755 - RNA, 19 nt, Artificial Sequence
  Synthetic Oligonucleotide
uggaauggguggcgguaau

SEQ ID NO: 11756 - RNA, 19 nt, Artificial Sequence
  Synthetic Oligonucleotide
ucaauugaagaaguggcgg

SEQ ID NO: 11757 - RNA, 19 nt, Artificial Sequence
  Synthetic Oligonucleotide
acucgauggggugccagcc

SEQ ID NO: 11758 - RNA, 19 nt, Artificial Sequence
  Synthetic Oligonucleotide
ccuccucaauugaagaagu

SEQ ID NO: 11759 - RNA, 19 nt, Artificial Sequence
  Synthetic Oligonucleotide
aauuggaauggguggcggu

SEQ ID NO: 11760 - RNA, 19 nt, Artificial Sequence
  Synthetic Oligonucleotide
gaaaaauccuuuggccguu

SEQ ID NO: 11761 - RNA, 19 nt, Artificial Sequence
  Synthetic Oligonucleotide
aagggaagguggaagucuu

SEQ ID NO: 11762 - RNA, 19 nt, Artificial Sequence
  Synthetic Oligonucleotide
cagcugggaagauaucaaa

SEQ ID NO: 11763 - RNA, 19 nt, Artificial Sequence
  Synthetic Oligonucleotide
ccucaauugaagaaguggc

SEQ ID NO: 11764 - RNA, 19 nt, Artificial Sequence
  Synthetic Oligonucleotide
acuucuguuuuaggacaga

SEQ ID NO: 11765 - RNA, 19 nt, Artificial Sequence
  Synthetic Oligonucleotide
cacuggagagaauuggaau

SEQ ID NO: 11766 - RNA, 19 nt, Artificial Sequence
  Synthetic Oligonucleotide
caaucguuuggggcuuagc

SEQ ID NO: 11767 - RNA, 19 nt, Artificial Sequence
  Synthetic Oligonucleotide
gccaccuccucaauugaag

SEQ ID NO: 11768 - RNA, 19 nt, Artificial Sequence
  Synthetic Oligonucleotide
uguuaaacauggcuugaau

SEQ ID NO: 11769 - RNA, 19 nt, Artificial Sequence
  Synthetic Oligonucleotide
ugauguucugaaagcucug

SEQ ID NO: 11770 - RNA, 19 nt, Artificial Sequence
  Synthetic Oligonucleotide
gcguaacagauucaaacug

SEQ ID NO: 11771 - RNA, 19 nt, Artificial Sequence
  Synthetic Oligonucleotide
uucaaacugccgccacaac

SEQ ID NO: 11772 - RNA, 19 nt, Artificial Sequence
  Synthetic Oligonucleotide
uuggaauggguggcgguaa

SEQ ID NO: 11773 - RNA, 19 nt, Artificial Sequence
  Synthetic Oligonucleotide
aggaaaaauccuuuggccg

SEQ ID NO: 11774 - RNA, 19 nt, Artificial Sequence
  Synthetic Oligonucleotide
ggcaggcuaaagugcugua

SEQ ID NO: 11775 - RNA, 19 nt, Artificial Sequence
  Synthetic Oligonucleotide
ugaugccagggaggcuguu

SEQ ID NO: 11776 - RNA, 19 nt, Artificial Sequence
  Synthetic Oligonucleotide
ugccacugugagagccugu

SEQ ID NO: 11777 - RNA, 19 nt, Artificial Sequence
  Synthetic Oligonucleotide
auuuugagaggugaugaug

SEQ ID NO: 11778 - RNA, 19 nt, Artificial Sequence
  Synthetic Oligonucleotide
uuccugggccaccuccuca

SEQ ID NO: 11779 - RNA, 19 nt, Artificial Sequence
  Synthetic Oligonucleotide
auaugacuauuacaggucu

SEQ ID NO: 11780 - RNA, 19 nt, Artificial Sequence
  Synthetic Oligonucleotide
caguggacuugcugcauau

SEQ ID NO: 11781 - RNA, 19 nt, Artificial Sequence
  Synthetic Oligonucleotide
uuuagacaacgucaucccc

SEQ ID NO: 11782 - RNA, 19 nt, Artificial Sequence
  Synthetic Oligonucleotide
uucugccagaaauugugga

SEQ ID NO: 11783 - RNA, 19 nt, Artificial Sequence
  Synthetic Oligonucleotide
cucgauggggugccagcca

SEQ ID NO: 11784 - RNA, 19 nt, Artificial Sequence
  Synthetic Oligonucleotide
gaagucaccaagaagcuag

SEQ ID NO: 11785 - RNA, 19 nt, Artificial Sequence
  Synthetic Oligonucleotide
ugugcggaaaggcacugau

SEQ ID NO: 11786 - RNA, 19 nt, Artificial Sequence
  Synthetic Oligonucleotide
aggcuguuaaacauggcuu

SEQ ID NO: 11787 - RNA, 19 nt, Artificial Sequence
  Synthetic Oligonucleotide
guggaggcuguggaaggga

SEQ ID NO: 11788 - RNA, 19 nt, Artificial Sequence
  Synthetic Oligonucleotide
uggugucgaaucauggggc

SEQ ID NO: 11789 - RNA, 19 nt, Artificial Sequence
  Synthetic Oligonucleotide
ucaaacugccgccacaacu

SEQ ID NO: 11790 - RNA, 19 nt, Artificial Sequence
  Synthetic Oligonucleotide
gaugaugccagggaggcug

SEQ ID NO: 11791 - RNA, 19 nt, Artificial Sequence
  Synthetic Oligonucleotide
augacuauuacaggucugg

SEQ ID NO: 11792 - RNA, 19 nt, Artificial Sequence
  Synthetic Oligonucleotide
gacaacucgauggggugcc

SEQ ID NO: 11793 - RNA, 19 nt, Artificial Sequence
  Synthetic Oligonucleotide
ggugaggaaaaauccuuug

SEQ ID NO: 11794 - RNA, 19 nt, Artificial Sequence
  Synthetic Oligonucleotide
aaaggaagaauuccgguug

SEQ ID NO: 11795 - RNA, 19 nt, Artificial Sequence
  Synthetic Oligonucleotide
guaacagauucaaacugcc

SEQ ID NO: 11796 - RNA, 19 nt, Artificial Sequence
  Synthetic Oligonucleotide
uugccacugugagagccug

SEQ ID NO: 11797 - RNA, 19 nt, Artificial Sequence
  Synthetic Oligonucleotide
ugggaacgggcaugauguu

SEQ ID NO: 11798 - RNA, 19 nt, Artificial Sequence
  Synthetic Oligonucleotide
ugccagaaauuguggaggc

SEQ ID NO: 11799 - RNA, 19 nt, Artificial Sequence
  Synthetic Oligonucleotide
uaugacuauuacaggucug

SEQ ID NO: 11800 - RNA, 19 nt, Artificial Sequence
  Synthetic Oligonucleotide
acgggcaugauguugaguu

SEQ ID NO: 11801 - RNA, 19 nt, Artificial Sequence
  Synthetic Oligonucleotide
ggcuguuaaacauggcuug

SEQ ID NO: 11802 - RNA, 19 nt, Artificial Sequence
  Synthetic Oligonucleotide
cacugauguucugaaagcu

SEQ ID NO: 11803 - RNA, 19 nt, Artificial Sequence
  Synthetic Oligonucleotide
gggaucuuggugucgaauc

SEQ ID NO: 11804 - RNA, 19 nt, Artificial Sequence
  Synthetic Oligonucleotide
accaaucguuuggggcuua

SEQ ID NO: 11805 - RNA, 19 nt, Artificial Sequence
  Synthetic Oligonucleotide
gacaacgucauccccuggc

SEQ ID NO: 11806 - RNA, 19 nt, Artificial Sequence
  Synthetic Oligonucleotide
ugugcagagggugaccaca

SEQ ID NO: 11807 - RNA, 19 nt, Artificial Sequence
  Synthetic Oligonucleotide
ucgauggggugccagccac

SEQ ID NO: 11808 - RNA, 19 nt, Artificial Sequence
  Synthetic Oligonucleotide
accugggcaaccgucugga

SEQ ID NO: 11809 - RNA, 19 nt, Artificial Sequence
  Synthetic Oligonucleotide
gaagcuguauccaaggaug

SEQ ID NO: 11810 - RNA, 19 nt, Artificial Sequence
  Synthetic Oligonucleotide
gugucgaaucauggggcuc

SEQ ID NO: 11811 - RNA, 19 nt, Artificial Sequence
  Synthetic Oligonucleotide
gacuauuacaggucugggg

SEQ ID NO: 11812 - RNA, 19 nt, Artificial Sequence
  Synthetic Oligonucleotide
ccugggcaaccgucuggau

SEQ ID NO: 11813 - RNA, 19 nt, Artificial Sequence
  Synthetic Oligonucleotide
gucgaaucauggggcucga

SEQ ID NO: 11814 - RNA, 19 nt, Artificial Sequence
  Synthetic Oligonucleotide
ccaccuccucaauugaaga

SEQ ID NO: 11815 - RNA, 19 nt, Artificial Sequence
  Synthetic Oligonucleotide
ggcuguggaagggaaggug

SEQ ID NO: 11816 - RNA, 19 nt, Artificial Sequence
  Synthetic Oligonucleotide
uuuaggacagagggucagc

SEQ ID NO: 11817 - RNA, 19 nt, Artificial Sequence
  Synthetic Oligonucleotide
aaaaauccuuuggccguuu

SEQ ID NO: 11818 - RNA, 19 nt, Artificial Sequence
  Synthetic Oligonucleotide
gauguucugaaagcucugg

SEQ ID NO: 11819 - RNA, 19 nt, Artificial Sequence
  Synthetic Oligonucleotide
cuucuguuuuaggacagag

SEQ ID NO: 11820 - RNA, 19 nt, Artificial Sequence
  Synthetic Oligonucleotide
gggaagguggaagucuucc

SEQ ID NO: 11821 - RNA, 19 nt, Artificial Sequence
  Synthetic Oligonucleotide
ucuccugaggaaaauuuug

SEQ ID NO: 11822 - RNA, 19 nt, Artificial Sequence
  Synthetic Oligonucleotide
agaagcuagugcggcaggc

SEQ ID NO: 11823 - RNA, 19 nt, Artificial Sequence
  Synthetic Oligonucleotide
uguggaagggaagguggaa

SEQ ID NO: 11824 - RNA, 19 nt, Artificial Sequence
  Synthetic Oligonucleotide
gaggcacuucguuggcugc

SEQ ID NO: 11825 - RNA, 19 nt, Artificial Sequence
  Synthetic Oligonucleotide
ugcguaacagauucaaacu

SEQ ID NO: 11826 - RNA, 19 nt, Artificial Sequence
  Synthetic Oligonucleotide
cuuuggccguuuccaagau

SEQ ID NO: 11827 - RNA, 19 nt, Artificial Sequence
  Synthetic Oligonucleotide
ucgaaucauggggcucgac

SEQ ID NO: 11828 - RNA, 19 nt, Artificial Sequence
  Synthetic Oligonucleotide
uggccguuuccaagaucug

SEQ ID NO: 11829 - RNA, 19 nt, Artificial Sequence
  Synthetic Oligonucleotide
cgucauccccuggcaggcu

SEQ ID NO: 11830 - RNA, 19 nt, Artificial Sequence
  Synthetic Oligonucleotide
gugaggaaaaauccuuugg

SEQ ID NO: 11831 - RNA, 19 nt, Artificial Sequence
  Synthetic Oligonucleotide
ugaugaugccagggaggcu

SEQ ID NO: 11832 - RNA, 19 nt, Artificial Sequence
  Synthetic Oligonucleotide
uaaaggaagaauuccgguu

SEQ ID NO: 11833 - RNA, 19 nt, Artificial Sequence
  Synthetic Oligonucleotide
uucuguuuuaggacagagg

SEQ ID NO: 11834 - RNA, 19 nt, Artificial Sequence
  Synthetic Oligonucleotide
uuuggccguuuccaagauc

SEQ ID NO: 11835 - RNA, 19 nt, Artificial Sequence
  Synthetic Oligonucleotide
accuccucaauugaagaag

SEQ ID NO: 11836 - RNA, 19 nt, Artificial Sequence
  Synthetic Oligonucleotide
ccuuuggccguuuccaaga

SEQ ID NO: 11837 - RNA, 19 nt, Artificial Sequence
  Synthetic Oligonucleotide
ugucgaaucauggggcucg

SEQ ID NO: 11838 - RNA, 19 nt, Artificial Sequence
  Synthetic Oligonucleotide
aggcuguggaagggaaggu

SEQ ID NO: 11839 - RNA, 19 nt, Artificial Sequence
  Synthetic Oligonucleotide
uguggaggcuguggaaggg

SEQ ID NO: 11840 - RNA, 19 nt, Artificial Sequence
  Synthetic Oligonucleotide
aaucguuuggggcuuagcu

SEQ ID NO: 11841 - RNA, 19 nt, Artificial Sequence
  Synthetic Oligonucleotide
cagaaauuguggaggcugu

SEQ ID NO: 11842 - RNA, 19 nt, Artificial Sequence
  Synthetic Oligonucleotide
cugggcaaccgucuggaug

SEQ ID NO: 11843 - RNA, 19 nt, Artificial Sequence
  Synthetic Oligonucleotide
gaagcugguccugaggcac

SEQ ID NO: 11844 - RNA, 19 nt, Artificial Sequence
  Synthetic Oligonucleotide
acauggcuugaaugggauc

SEQ ID NO: 11845 - RNA, 19 nt, Artificial Sequence
  Synthetic Oligonucleotide
ggcacuucguuggcugcaa

SEQ ID NO: 11846 - RNA, 19 nt, Artificial Sequence
  Synthetic Oligonucleotide
gugagagccugucaguccc

SEQ ID NO: 11847 - RNA, 19 nt, Artificial Sequence
  Synthetic Oligonucleotide
augccagggaggcuguuaa

SEQ ID NO: 11848 - RNA, 19 nt, Artificial Sequence
  Synthetic Oligonucleotide
uuggugaggaaaaauccuu

SEQ ID NO: 11849 - RNA, 19 nt, Artificial Sequence
  Synthetic Oligonucleotide
cacugugagagccugucag

SEQ ID NO: 11850 - RNA, 19 nt, Artificial Sequence
  Synthetic Oligonucleotide
gacggcgagcuugccacug

SEQ ID NO: 11851 - RNA, 19 nt, Artificial Sequence
  Synthetic Oligonucleotide
aagcugguccugaggcacu

SEQ ID NO: 11852 - RNA, 19 nt, Artificial Sequence
  Synthetic Oligonucleotide
ccugggaacgggcaugaug

SEQ ID NO: 11853 - RNA, 19 nt, Artificial Sequence
  Synthetic Oligonucleotide
ugggaucuuggugucgaau

SEQ ID NO: 11854 - RNA, 19 nt, Artificial Sequence
  Synthetic Oligonucleotide
guuccugggccaccuccuc

SEQ ID NO: 11855 - RNA, 19 nt, Artificial Sequence
  Synthetic Oligonucleotide
aaaauccuuuggccguuuc

SEQ ID NO: 11856 - RNA, 19 nt, Artificial Sequence
  Synthetic Oligonucleotide
agggaagguggaagucuuc

SEQ ID NO: 11857 - RNA, 19 nt, Artificial Sequence
  Synthetic Oligonucleotide
gaguuccugggccaccucc

SEQ ID NO: 11858 - RNA, 19 nt, Artificial Sequence
  Synthetic Oligonucleotide
auugaagaaguggcggaag

SEQ ID NO: 11859 - RNA, 19 nt, Artificial Sequence
  Synthetic Oligonucleotide
aucguuuggggcuuagcuu

SEQ ID NO: 11860 - RNA, 19 nt, Artificial Sequence
  Synthetic Oligonucleotide
uuggccguuuccaagaucu

SEQ ID NO: 11861 - RNA, 19 nt, Artificial Sequence
  Synthetic Oligonucleotide
ggaagaauuccgguuggcc

SEQ ID NO: 11862 - RNA, 19 nt, Artificial Sequence
  Synthetic Oligonucleotide
agggaggcuguuaaacaug

SEQ ID NO: 11863 - RNA, 19 nt, Artificial Sequence
  Synthetic Oligonucleotide
guuuguggggagaccaauc

SEQ ID NO: 11864 - RNA, 19 nt, Artificial Sequence
  Synthetic Oligonucleotide
agaaauuguggaggcugug

SEQ ID NO: 11865 - RNA, 19 nt, Artificial Sequence
  Synthetic Oligonucleotide
caggcuaaagugcuguauc

SEQ ID NO: 11866 - RNA, 19 nt, Artificial Sequence
  Synthetic Oligonucleotide
gagaagaugggcuacaagg

SEQ ID NO: 11867 - RNA, 19 nt, Artificial Sequence
  Synthetic Oligonucleotide
aagucaccaagaagcuagu

SEQ ID NO: 11868 - RNA, 19 nt, Artificial Sequence
  Synthetic Oligonucleotide
guggacggcgagcuugcca

SEQ ID NO: 11869 - RNA, 19 nt, Artificial Sequence
  Synthetic Oligonucleotide
acugugagagccugucagu

SEQ ID NO: 11870 - RNA, 19 nt, Artificial Sequence
  Synthetic Oligonucleotide
uuuucaauggguguccuag

SEQ ID NO: 11871 - RNA, 19 nt, Artificial Sequence
  Synthetic Oligonucleotide
uguauccaaggaugcuccg

SEQ ID NO: 11872 - RNA, 19 nt, Artificial Sequence
  Synthetic Oligonucleotide
guugaguuccugggccacc

SEQ ID NO: 11873 - RNA, 19 nt, Artificial Sequence
  Synthetic Oligonucleotide
aaauccuuuggccguuucc

SEQ ID NO: 11874 - RNA, 19 nt, Artificial Sequence
  Synthetic Oligonucleotide
uggcaggcuaaagugcugu

SEQ ID NO: 11875 - RNA, 19 nt, Artificial Sequence
  Synthetic Oligonucleotide
aauccuuuggccguuucca

SEQ ID NO: 11876 - RNA, 19 nt, Artificial Sequence
  Synthetic Oligonucleotide
aauuguggaggcuguggaa

SEQ ID NO: 11877 - RNA, 19 nt, Artificial Sequence
  Synthetic Oligonucleotide
ggagagaauuggaaugggu

SEQ ID NO: 11878 - RNA, 19 nt, Artificial Sequence
  Synthetic Oligonucleotide
gauguugaguuccugggcc

SEQ ID NO: 11879 - RNA, 19 nt, Artificial Sequence
  Synthetic Oligonucleotide
uguucugccagaaauugug

SEQ ID NO: 11880 - RNA, 19 nt, Artificial Sequence
  Synthetic Oligonucleotide
aagcuagugcggcaggcag

SEQ ID NO: 11881 - RNA, 19 nt, Artificial Sequence
  Synthetic Oligonucleotide
gaaucauggggcucgacaa

SEQ ID NO: 11882 - RNA, 19 nt, Artificial Sequence
  Synthetic Oligonucleotide
ccagggaggcuguuaaaca

SEQ ID NO: 11883 - RNA, 19 nt, Artificial Sequence
  Synthetic Oligonucleotide
cuggagagaauuggaaugg

SEQ ID NO: 11884 - RNA, 19 nt, Artificial Sequence
  Synthetic Oligonucleotide
agagaagaugggcuacaag

SEQ ID NO: 11885 - RNA, 19 nt, Artificial Sequence
  Synthetic Oligonucleotide
agaccaaucguuuggggcu

SEQ ID NO: 11886 - RNA, 19 nt, Artificial Sequence
  Synthetic Oligonucleotide
uuguggaggcuguggaagg

SEQ ID NO: 11887 - RNA, 19 nt, Artificial Sequence
  Synthetic Oligonucleotide
aaucauggggcucgacaac

SEQ ID NO: 11888 - RNA, 19 nt, Artificial Sequence
  Synthetic Oligonucleotide
ccugaggcacuucguuggc

SEQ ID NO: 11889 - RNA, 19 nt, Artificial Sequence
  Synthetic Oligonucleotide
ucccugggaacgggcauga

SEQ ID NO: 11890 - RNA, 19 nt, Artificial Sequence
  Synthetic Oligonucleotide
ugugagagccugucagucc

SEQ ID NO: 11891 - RNA, 19 nt, Artificial Sequence
  Synthetic Oligonucleotide
gagagaauuggaaugggug

SEQ ID NO: 11892 - RNA, 19 nt, Artificial Sequence
  Synthetic Oligonucleotide
ggcucugagugggugccag

SEQ ID NO: 11893 - RNA, 19 nt, Artificial Sequence
  Synthetic Oligonucleotide
agucaccaagaagcuagug

SEQ ID NO: 11894 - RNA, 19 nt, Artificial Sequence
  Synthetic Oligonucleotide
aaggaagaauuccgguugg

SEQ ID NO: 11895 - RNA, 19 nt, Artificial Sequence
  Synthetic Oligonucleotide
ggccguuuccaagaucuga

SEQ ID NO: 11896 - RNA, 19 nt, Artificial Sequence
  Synthetic Oligonucleotide
uccuuuggccguuuccaag

SEQ ID NO: 11897 - RNA, 19 nt, Artificial Sequence
  Synthetic Oligonucleotide
gcaggcagagaagaugggc

SEQ ID NO: 11898 - RNA, 19 nt, Artificial Sequence
  Synthetic Oligonucleotide
ugagagccugucagucccu

SEQ ID NO: 11899 - RNA, 19 nt, Artificial Sequence
  Synthetic Oligonucleotide
ucugccagaaauuguggag

SEQ ID NO: 11900 - RNA, 19 nt, Artificial Sequence
  Synthetic Oligonucleotide
gaagcuagugcggcaggca

SEQ ID NO: 11901 - RNA, 19 nt, Artificial Sequence
  Synthetic Oligonucleotide
auucaaacugccgccacaa

SEQ ID NO: 11902 - RNA, 19 nt, Artificial Sequence
  Synthetic Oligonucleotide
uuuguggggagaccaaucg

SEQ ID NO: 11903 - RNA, 19 nt, Artificial Sequence
  Synthetic Oligonucleotide
uuuuaggacagagggucag

SEQ ID NO: 11904 - RNA, 19 nt, Artificial Sequence
  Synthetic Oligonucleotide
ggaagguggaagucuuccu

SEQ ID NO: 11905 - RNA, 19 nt, Artificial Sequence
  Synthetic Oligonucleotide
uggugaggaaaaauccuuu

SEQ ID NO: 11906 - RNA, 19 nt, Artificial Sequence
  Synthetic Oligonucleotide
acaacgucauccccuggca

SEQ ID NO: 11907 - RNA, 19 nt, Artificial Sequence
  Synthetic Oligonucleotide
uuagacaacgucauccccu

SEQ ID NO: 11908 - RNA, 19 nt, Artificial Sequence
  Synthetic Oligonucleotide
ugaggaaaaauccuuuggc

SEQ ID NO: 11909 - RNA, 19 nt, Artificial Sequence
  Synthetic Oligonucleotide
caggcagagaagaugggcu

SEQ ID NO: 11910 - RNA, 19 nt, Artificial Sequence
  Synthetic Oligonucleotide
caccuccucaauugaagaa

SEQ ID NO: 11911 - RNA, 19 nt, Artificial Sequence
  Synthetic Oligonucleotide
ugauguugaguuccugggc

SEQ ID NO: 11912 - RNA, 19 nt, Artificial Sequence
  Synthetic Oligonucleotide
agagaauuggaaugggugg

SEQ ID NO: 11913 - RNA, 19 nt, Artificial Sequence
  Synthetic Oligonucleotide
uccucaauugaagaagugg

SEQ ID NO: 11914 - RNA, 19 nt, Artificial Sequence
  Synthetic Oligonucleotide
uggagagaauuggaauggg

SEQ ID NO: 11915 - RNA, 19 nt, Artificial Sequence
  Synthetic Oligonucleotide
cccuggcaggcuaaagugc

SEQ ID NO: 11916 - RNA, 19 nt, Artificial Sequence
  Synthetic Oligonucleotide
gaggcuguggaagggaagg

SEQ ID NO: 11917 - RNA, 19 nt, Artificial Sequence
  Synthetic Oligonucleotide
uggcucugagugggugcca

SEQ ID NO: 11918 - RNA, 19 nt, Artificial Sequence
  Synthetic Oligonucleotide
gucaccaagaagcuagugc

SEQ ID NO: 11919 - RNA, 19 nt, Artificial Sequence
  Synthetic Oligonucleotide
gaagaaguggcggaagcug

SEQ ID NO: 11920 - RNA, 19 nt, Artificial Sequence
  Synthetic Oligonucleotide
aguuccugggccaccuccu

SEQ ID NO: 11921 - RNA, 19 nt, Artificial Sequence
  Synthetic Oligonucleotide
cugaggcacuucguuggcu

SEQ ID NO: 11922 - RNA, 19 nt, Artificial Sequence
  Synthetic Oligonucleotide
uccugggccaccuccucaa

SEQ ID NO: 11923 - RNA, 19 nt, Artificial Sequence
  Synthetic Oligonucleotide
uggaggcuguggaagggaa

SEQ ID NO: 11924 - RNA, 19 nt, Artificial Sequence
  Synthetic Oligonucleotide
cuuggugucgaaucauggg

SEQ ID NO: 11925 - RNA, 19 nt, Artificial Sequence
  Synthetic Oligonucleotide
ggaggcuguggaagggaag

SEQ ID NO: 11926 - RNA, 19 nt, Artificial Sequence
  Synthetic Oligonucleotide
ggaucuuggugucgaauca

SEQ ID NO: 11927 - RNA, 19 nt, Artificial Sequence
  Synthetic Oligonucleotide
cccugggaacgggcaugau

SEQ ID NO: 11928 - RNA, 19 nt, Artificial Sequence
  Synthetic Oligonucleotide
uugagaggugaugaugcca

SEQ ID NO: 11929 - RNA, 19 nt, Artificial Sequence
  Synthetic Oligonucleotide
uggcuugaaugggaucuug

SEQ ID NO: 11930 - RNA, 19 nt, Artificial Sequence
  Synthetic Oligonucleotide
auggcucugagugggugcc

SEQ ID NO: 11931 - RNA, 19 nt, Artificial Sequence
  Synthetic Oligonucleotide
gaggugaugaugccaggga

SEQ ID NO: 11932 - RNA, 19 nt, Artificial Sequence
  Synthetic Oligonucleotide
gagcuugccacugugagag

SEQ ID NO: 11933 - RNA, 19 nt, Artificial Sequence
  Synthetic Oligonucleotide
uugaguuccugggccaccu

SEQ ID NO: 11934 - RNA, 19 nt, Artificial Sequence
  Synthetic Oligonucleotide
gcgagcuugccacugugag

SEQ ID NO: 11935 - RNA, 19 nt, Artificial Sequence
  Synthetic Oligonucleotide
uguggacggcgagcuugcc

SEQ ID NO: 11936 - RNA, 19 nt, Artificial Sequence
  Synthetic Oligonucleotide
auuguggaggcuguggaag

SEQ ID NO: 11937 - RNA, 19 nt, Artificial Sequence
  Synthetic Oligonucleotide
uugaagaaguggcggaagc

SEQ ID NO: 11938 - RNA, 19 nt, Artificial Sequence
  Synthetic Oligonucleotide
caacucgauggggugccag

SEQ ID NO: 11939 - RNA, 19 nt, Artificial Sequence
  Synthetic Oligonucleotide
gaagaauuccgguuggcca

SEQ ID NO: 11940 - RNA, 19 nt, Artificial Sequence
  Synthetic Oligonucleotide
gcagagaagaugggcuaca

SEQ ID NO: 11941 - RNA, 19 nt, Artificial Sequence
  Synthetic Oligonucleotide
ccaaucguuuggggcuuag

SEQ ID NO: 11942 - RNA, 19 nt, Artificial Sequence
  Synthetic Oligonucleotide
gaggaaaaauccuuuggcc

SEQ ID NO: 11943 - RNA, 19 nt, Artificial Sequence
  Synthetic Oligonucleotide
acgucauccccuggcaggc

SEQ ID NO: 11944 - RNA, 19 nt, Artificial Sequence
  Synthetic Oligonucleotide
cugugagagccugucaguc

SEQ ID NO: 11945 - RNA, 19 nt, Artificial Sequence
  Synthetic Oligonucleotide
gucauccccuggcaggcua

SEQ ID NO: 11946 - RNA, 19 nt, Artificial Sequence
  Synthetic Oligonucleotide
caacgucauccccuggcag

SEQ ID NO: 11947 - RNA, 19 nt, Artificial Sequence
  Synthetic Oligonucleotide
aucauggggcucgacaacu

SEQ ID NO: 11948 - RNA, 19 nt, Artificial Sequence
  Synthetic Oligonucleotide
auccuuuggccguuuccaa

SEQ ID NO: 11949 - RNA, 19 nt, Artificial Sequence
  Synthetic Oligonucleotide
ccuggcaggcuaaagugcu

SEQ ID NO: 11950 - RNA, 19 nt, Artificial Sequence
  Synthetic Oligonucleotide
uuggugucgaaucaugggg

SEQ ID NO: 11951 - RNA, 19 nt, Artificial Sequence
  Synthetic Oligonucleotide
auguggacggcgagcuugc

SEQ ID NO: 11952 - RNA, 19 nt, Artificial Sequence
  Synthetic Oligonucleotide
gaauuccgguuggccaugg

SEQ ID NO: 11953 - RNA, 19 nt, Artificial Sequence
  Synthetic Oligonucleotide
accaagaagcuagugcggc

SEQ ID NO: 11954 - RNA, 19 nt, Artificial Sequence
  Synthetic Oligonucleotide
aagguggaagucuuccugg

SEQ ID NO: 11955 - RNA, 19 nt, Artificial Sequence
  Synthetic Oligonucleotide
auguugaguuccugggcca

SEQ ID NO: 11956 - RNA, 19 nt, Artificial Sequence
  Synthetic Oligonucleotide
cuuaccugggcaaccgucu

SEQ ID NO: 11957 - RNA, 19 nt, Artificial Sequence
  Synthetic Oligonucleotide
acaacucgauggggugcca

SEQ ID NO: 11958 - RNA, 19 nt, Artificial Sequence
  Synthetic Oligonucleotide
agaggugaugaugccaggg

SEQ ID NO: 11959 - RNA, 19 nt, Artificial Sequence
  Synthetic Oligonucleotide
gggcaaccgucuggaugau

SEQ ID NO: 11960 - RNA, 19 nt, Artificial Sequence
  Synthetic Oligonucleotide
cuggcaggcuaaagugcug

SEQ ID NO: 11961 - RNA, 19 nt, Artificial Sequence
  Synthetic Oligonucleotide
cgagcuugccacugugaga

SEQ ID NO: 11962 - RNA, 19 nt, Artificial Sequence
  Synthetic Oligonucleotide
agaaguggcggaagcuggu

SEQ ID NO: 11963 - RNA, 19 nt, Artificial Sequence
  Synthetic Oligonucleotide
cuagugcggcaggcagaga

SEQ ID NO: 11964 - RNA, 19 nt, Artificial Sequence
  Synthetic Oligonucleotide
uuguggggagaccaaucgu

SEQ ID NO: 11965 - RNA, 19 nt, Artificial Sequence
  Synthetic Oligonucleotide
aauuccgguuggccauggc

SEQ ID NO: 11966 - RNA, 19 nt, Artificial Sequence
  Synthetic Oligonucleotide
augauguugaguuccuggg

SEQ ID NO: 11967 - RNA, 19 nt, Artificial Sequence
  Synthetic Oligonucleotide
ggugaugaugccagggagg

SEQ ID NO: 11968 - RNA, 19 nt, Artificial Sequence
  Synthetic Oligonucleotide
agcuagugcggcaggcaga

SEQ ID NO: 11969 - RNA, 19 nt, Artificial Sequence
  Synthetic Oligonucleotide
aacucgauggggugccagc

SEQ ID NO: 11970 - RNA, 19 nt, Artificial Sequence
  Synthetic Oligonucleotide
acggcgagcuugccacugu

SEQ ID NO: 11971 - RNA, 19 nt, Artificial Sequence
  Synthetic Oligonucleotide
aggaagaauuccgguuggc

SEQ ID NO: 11972 - RNA, 19 nt, Artificial Sequence
  Synthetic Oligonucleotide
cucgacaacucgauggggu

SEQ ID NO: 11973 - RNA, 19 nt, Artificial Sequence
  Synthetic Oligonucleotide
acuggagagaauuggaaug

SEQ ID NO: 11974 - RNA, 19 nt, Artificial Sequence
  Synthetic Oligonucleotide
aggugaugaugccagggag

SEQ ID NO: 11975 - RNA, 19 nt, Artificial Sequence
  Synthetic Oligonucleotide
cugccagaaauuguggagg

SEQ ID NO: 11976 - RNA, 19 nt, Artificial Sequence
  Synthetic Oligonucleotide
ugaagaaguggcggaagcu

SEQ ID NO: 11977 - RNA, 19 nt, Artificial Sequence
  Synthetic Oligonucleotide
gagaccaaucguuuggggc

SEQ ID NO: 11978 - RNA, 19 nt, Artificial Sequence
  Synthetic Oligonucleotide
ggacggcgagcuugccacu

SEQ ID NO: 11979 - RNA, 19 nt, Artificial Sequence
  Synthetic Oligonucleotide
caccuuaccugggcaaccg

SEQ ID NO: 11980 - RNA, 19 nt, Artificial Sequence
  Synthetic Oligonucleotide
gaucuuggugucgaaucau

SEQ ID NO: 11981 - RNA, 19 nt, Artificial Sequence
  Synthetic Oligonucleotide
ccaagaagcuagugcggca

SEQ ID NO: 11982 - RNA, 19 nt, Artificial Sequence
  Synthetic Oligonucleotide
ugaguuccugggccaccuc

SEQ ID NO: 11983 - RNA, 19 nt, Artificial Sequence
  Synthetic Oligonucleotide
agucccugggaacgggcau

SEQ ID NO: 11984 - RNA, 19 nt, Artificial Sequence
  Synthetic Oligonucleotide
cgacaacucgauggggugc

SEQ ID NO: 11985 - RNA, 19 nt, Artificial Sequence
  Synthetic Oligonucleotide
aucuuggugucgaaucaug

SEQ ID NO: 11986 - RNA, 19 nt, Artificial Sequence
  Synthetic Oligonucleotide
gcuagugcggcaggcagag

SEQ ID NO: 11987 - RNA, 19 nt, Artificial Sequence
  Synthetic Oligonucleotide
cggcgagcuugccacugug

SEQ ID NO: 11988 - RNA, 19 nt, Artificial Sequence
  Synthetic Oligonucleotide
ugaggcacuucguuggcug

SEQ ID NO: 11989 - RNA, 19 nt, Artificial Sequence
  Synthetic Oligonucleotide
ggcaugauguugaguuccu

SEQ ID NO: 11990 - RNA, 19 nt, Artificial Sequence
  Synthetic Oligonucleotide
ggcgagcuugccacuguga

SEQ ID NO: 11991 - RNA, 19 nt, Artificial Sequence
  Synthetic Oligonucleotide
gagagccugucagucccug

SEQ ID NO: 11992 - RNA, 19 nt, Artificial Sequence
  Synthetic Oligonucleotide
ucagucccugggaacgggc

SEQ ID NO: 11993 - RNA, 19 nt, Artificial Sequence
  Synthetic Oligonucleotide
ccguuuccaagaucugaca

SEQ ID NO: 11994 - RNA, 19 nt, Artificial Sequence
  Synthetic Oligonucleotide
cagagaagaugggcuacaa

SEQ ID NO: 11995 - RNA, 19 nt, Artificial Sequence
  Synthetic Oligonucleotide
cgggcaugauguugaguuc

SEQ ID NO: 11996 - RNA, 19 nt, Artificial Sequence
  Synthetic Oligonucleotide
uaccugggcaaccgucugg

SEQ ID NO: 11997 - RNA, 19 nt, Artificial Sequence
  Synthetic Oligonucleotide
gucccugggaacgggcaug

SEQ ID NO: 11998 - RNA, 19 nt, Artificial Sequence
  Synthetic Oligonucleotide
agcugguccugaggcacuu

SEQ ID NO: 11999 - RNA, 19 nt, Artificial Sequence
  Synthetic Oligonucleotide
gaagguggaagucuuccug

SEQ ID NO: 12000 - RNA, 19 nt, Artificial Sequence
  Synthetic Oligonucleotide
cagucccugggaacgggca

SEQ ID NO: 12001 - RNA, 19 nt, Artificial Sequence
  Synthetic Oligonucleotide
agagccugucagucccugg

SEQ ID NO: 12002 - RNA, 19 nt, Artificial Sequence
  Synthetic Oligonucleotide
ccuuaccugggcaaccguc

SEQ ID NO: 12003 - RNA, 19 nt, Artificial Sequence
  Synthetic Oligonucleotide
auggggcucgacaacucga

SEQ ID NO: 12004 - RNA, 19 nt, Artificial Sequence
  Synthetic Oligonucleotide
augcagcgcauggcucaug

SEQ ID NO: 12005 - RNA, 19 nt, Artificial Sequence
  Synthetic Oligonucleotide
ggagaccaaucguuugggg

SEQ ID NO: 12006 - RNA, 19 nt, Artificial Sequence
  Synthetic Oligonucleotide
auccccuggcaggcuaaag

SEQ ID NO: 12007 - RNA, 19 nt, Artificial Sequence
  Synthetic Oligonucleotide
guggggagaccaaucguuu

SEQ ID NO: 12008 - RNA, 19 nt, Artificial Sequence
  Synthetic Oligonucleotide
aagaagcuagugcggcagg

SEQ ID NO: 12009 - RNA, 19 nt, Artificial Sequence
  Synthetic Oligonucleotide
aacgucauccccuggcagg

SEQ ID NO: 12010 - RNA, 19 nt, Artificial Sequence
  Synthetic Oligonucleotide
gggcaugauguugaguucc

SEQ ID NO: 12011 - RNA, 19 nt, Artificial Sequence
  Synthetic Oligonucleotide
ugagaggugaugaugccag

SEQ ID NO: 12012 - RNA, 19 nt, Artificial Sequence
  Synthetic Oligonucleotide
guucugaaagcucuggcuc

SEQ ID NO: 12013 - RNA, 19 nt, Artificial Sequence
  Synthetic Oligonucleotide
uggacggcgagcuugccac

SEQ ID NO: 12014 - RNA, 19 nt, Artificial Sequence
  Synthetic Oligonucleotide
cagggaggcuguuaaacau

SEQ ID NO: 12015 - RNA, 19 nt, Artificial Sequence
  Synthetic Oligonucleotide
agacaacgucauccccugg

SEQ ID NO: 12016 - RNA, 19 nt, Artificial Sequence
  Synthetic Oligonucleotide
ugggcaaccgucuggauga

SEQ ID NO: 12017 - RNA, 19 nt, Artificial Sequence
  Synthetic Oligonucleotide
uccccuggcaggcuaaagu

SEQ ID NO: 12018 - RNA, 19 nt, Artificial Sequence
  Synthetic Oligonucleotide
uggaaauauauuaacuguu

SEQ ID NO: 12019 - RNA, 19 nt, Artificial Sequence
  Synthetic Oligonucleotide
aaugaucucauuguuuauu

SEQ ID NO: 12020 - RNA, 19 nt, Artificial Sequence
  Synthetic Oligonucleotide
agauaaugaucucauuguu

SEQ ID NO: 12021 - RNA, 19 nt, Artificial Sequence
  Synthetic Oligonucleotide
ggaaauauauuaacuguua

SEQ ID NO: 12022 - RNA, 19 nt, Artificial Sequence
  Synthetic Oligonucleotide
ucagcauguauuacuugac

SEQ ID NO: 12023 - RNA, 19 nt, Artificial Sequence
  Synthetic Oligonucleotide
ccuggaaauauauuaacug

SEQ ID NO: 12024 - RNA, 19 nt, Artificial Sequence
  Synthetic Oligonucleotide
aagauaaugaucucauugu

SEQ ID NO: 12025 - RNA, 19 nt, Artificial Sequence
  Synthetic Oligonucleotide
aauuuugaaaccaguacuu

SEQ ID NO: 12026 - RNA, 19 nt, Artificial Sequence
  Synthetic Oligonucleotide
ugaaaccaguacuuuauca

SEQ ID NO: 12027 - RNA, 19 nt, Artificial Sequence
  Synthetic Oligonucleotide
cuggaaauauauuaacugu

SEQ ID NO: 12028 - RNA, 19 nt, Artificial Sequence
  Synthetic Oligonucleotide
acaaaauagcaaucccuuu

SEQ ID NO: 12029 - RNA, 19 nt, Artificial Sequence
  Synthetic Oligonucleotide
uaaugaucucauuguuuau

SEQ ID NO: 12030 - RNA, 19 nt, Artificial Sequence
  Synthetic Oligonucleotide
acagugguucuuaaauugu

SEQ ID NO: 12031 - RNA, 19 nt, Artificial Sequence
  Synthetic Oligonucleotide
gacuuucauccuggaaaua

SEQ ID NO: 12032 - RNA, 19 nt, Artificial Sequence
  Synthetic Oligonucleotide
uaugaacaacaugcuaaau

SEQ ID NO: 12033 - RNA, 19 nt, Artificial Sequence
  Synthetic Oligonucleotide
ugaaaagauaaugaucuca

SEQ ID NO: 12034 - RNA, 19 nt, Artificial Sequence
  Synthetic Oligonucleotide
ggugauacuucuuugaaug

SEQ ID NO: 12035 - RNA, 19 nt, Artificial Sequence
  Synthetic Oligonucleotide
gaagacugacaucauugcc

SEQ ID NO: 12036 - RNA, 19 nt, Artificial Sequence
  Synthetic Oligonucleotide
ggacuuucauccuggaaau

SEQ ID NO: 12037 - RNA, 19 nt, Artificial Sequence
  Synthetic Oligonucleotide
cauccuggaaauauauuaa

SEQ ID NO: 12038 - RNA, 19 nt, Artificial Sequence
  Synthetic Oligonucleotide
agaagacugacaucauugc

SEQ ID NO: 12039 - RNA, 19 nt, Artificial Sequence
  Synthetic Oligonucleotide
auuggugauacuucuuuga

SEQ ID NO: 12040 - RNA, 19 nt, Artificial Sequence
  Synthetic Oligonucleotide
ucauuguuuauuaaccugu

SEQ ID NO: 12041 - RNA, 19 nt, Artificial Sequence
  Synthetic Oligonucleotide
ggugaaaagauaaugaucu

SEQ ID NO: 12042 - RNA, 19 nt, Artificial Sequence
  Synthetic Oligonucleotide
uucauccuggaaauauauu

SEQ ID NO: 12043 - RNA, 19 nt, Artificial Sequence
  Synthetic Oligonucleotide
caaaauagcaaucccuuuu

SEQ ID NO: 12044 - RNA, 19 nt, Artificial Sequence
  Synthetic Oligonucleotide
gauaaugaucucauuguuu

SEQ ID NO: 12045 - RNA, 19 nt, Artificial Sequence
  Synthetic Oligonucleotide
uuucauccuggaaauauau

SEQ ID NO: 12046 - RNA, 19 nt, Artificial Sequence
  Synthetic Oligonucleotide
agcaaucccuuuuauuuca

SEQ ID NO: 12047 - RNA, 19 nt, Artificial Sequence
  Synthetic Oligonucleotide
aaaauagcaaucccuuuua

SEQ ID NO: 12048 - RNA, 19 nt, Artificial Sequence
  Synthetic Oligonucleotide
cagcauguauuacuugaca

SEQ ID NO: 12049 - RNA, 19 nt, Artificial Sequence
  Synthetic Oligonucleotide
uaauuggugauacuucuuu

SEQ ID NO: 12050 - RNA, 19 nt, Artificial Sequence
  Synthetic Oligonucleotide
ggauagcaauaaccuguga

SEQ ID NO: 12051 - RNA, 19 nt, Artificial Sequence
  Synthetic Oligonucleotide
cauuguuuauuaaccugua

SEQ ID NO: 12052 - RNA, 19 nt, Artificial Sequence
  Synthetic Oligonucleotide
acaacucaggaugaaaaau

SEQ ID NO: 12053 - RNA, 19 nt, Artificial Sequence
  Synthetic Oligonucleotide
ucauccuggaaauauauua

SEQ ID NO: 12054 - RNA, 19 nt, Artificial Sequence
  Synthetic Oligonucleotide
gggauagcaauaaccugug

SEQ ID NO: 12055 - RNA, 19 nt, Artificial Sequence
  Synthetic Oligonucleotide
aauuggugauacuucuuug

SEQ ID NO: 12056 - RNA, 19 nt, Artificial Sequence
  Synthetic Oligonucleotide
ugaaaaauuuugaaaccag

SEQ ID NO: 12057 - RNA, 19 nt, Artificial Sequence
  Synthetic Oligonucleotide
auuuguaucaaugauuaug

SEQ ID NO: 12058 - RNA, 19 nt, Artificial Sequence
  Synthetic Oligonucleotide
gcuaauuuguaucaaugau

SEQ ID NO: 12059 - RNA, 19 nt, Artificial Sequence
  Synthetic Oligonucleotide
ucugaauauauccaaaugu

SEQ ID NO: 12060 - RNA, 19 nt, Artificial Sequence
  Synthetic Oligonucleotide
aacagugguucuuaaauug

SEQ ID NO: 12061 - RNA, 19 nt, Artificial Sequence
  Synthetic Oligonucleotide
gaucucauuguuuauuaac

SEQ ID NO: 12062 - RNA, 19 nt, Artificial Sequence
  Synthetic Oligonucleotide
cucauuguuuauuaaccug

SEQ ID NO: 12063 - RNA, 19 nt, Artificial Sequence
  Synthetic Oligonucleotide
uuuuuucagcauguauuac

SEQ ID NO: 12064 - RNA, 19 nt, Artificial Sequence
  Synthetic Oligonucleotide
accaguacuuuaucauuuu

SEQ ID NO: 12065 - RNA, 19 nt, Artificial Sequence
  Synthetic Oligonucleotide
uaaugccugauucacaacu

SEQ ID NO: 12066 - RNA, 19 nt, Artificial Sequence
  Synthetic Oligonucleotide
aaauuuugaaaccaguacu

SEQ ID NO: 12067 - RNA, 19 nt, Artificial Sequence
  Synthetic Oligonucleotide
uagcaaucccuuuuauuuc

SEQ ID NO: 12068 - RNA, 19 nt, Artificial Sequence
  Synthetic Oligonucleotide
ggcuaauuuguaucaauga

SEQ ID NO: 12069 - RNA, 19 nt, Artificial Sequence
  Synthetic Oligonucleotide
uccuggaaauauauuaacu

SEQ ID NO: 12070 - RNA, 19 nt, Artificial Sequence
  Synthetic Oligonucleotide
aaagauaaugaucucauug

SEQ ID NO: 12071 - RNA, 19 nt, Artificial Sequence
  Synthetic Oligonucleotide
ugaauauauccaaauguuu

SEQ ID NO: 12072 - RNA, 19 nt, Artificial Sequence
  Synthetic Oligonucleotide
aauuuguaucaaugauuau

SEQ ID NO: 12073 - RNA, 19 nt, Artificial Sequence
  Synthetic Oligonucleotide
cugacaucauugccaauug

SEQ ID NO: 12074 - RNA, 19 nt, Artificial Sequence
  Synthetic Oligonucleotide
augauuaugaacaacaugc

SEQ ID NO: 12075 - RNA, 19 nt, Artificial Sequence
  Synthetic Oligonucleotide
aaauagcaaucccuuuuau

SEQ ID NO: 12076 - RNA, 19 nt, Artificial Sequence
  Synthetic Oligonucleotide
gauagcaauaaccugugaa

SEQ ID NO: 12077 - RNA, 19 nt, Artificial Sequence
  Synthetic Oligonucleotide
cuaauuuguaucaaugauu

SEQ ID NO: 12078 - RNA, 19 nt, Artificial Sequence
  Synthetic Oligonucleotide
gaacaacaugcuaaaucag

SEQ ID NO: 12079 - RNA, 19 nt, Artificial Sequence
  Synthetic Oligonucleotide
uauuucauugcuuuugacu

SEQ ID NO: 12080 - RNA, 19 nt, Artificial Sequence
  Synthetic Oligonucleotide
aauuguaagcucagguuca

SEQ ID NO: 12081 - RNA, 19 nt, Artificial Sequence
  Synthetic Oligonucleotide
acugacaucauugccaauu

SEQ ID NO: 12082 - RNA, 19 nt, Artificial Sequence
  Synthetic Oligonucleotide
augaucucauuguuuauua

SEQ ID NO: 12083 - RNA, 19 nt, Artificial Sequence
  Synthetic Oligonucleotide
gauuaugaacaacaugcua

SEQ ID NO: 12084 - RNA, 19 nt, Artificial Sequence
  Synthetic Oligonucleotide
aauggacuuucauccugga

SEQ ID NO: 12085 - RNA, 19 nt, Artificial Sequence
  Synthetic Oligonucleotide
aaguguugguaaugccuga

SEQ ID NO: 12086 - RNA, 19 nt, Artificial Sequence
  Synthetic Oligonucleotide
uguaucaaugauuaugaac

SEQ ID NO: 12087 - RNA, 19 nt, Artificial Sequence
  Synthetic Oligonucleotide
aaucccuuuuauuucauug

SEQ ID NO: 12088 - RNA, 19 nt, Artificial Sequence
  Synthetic Oligonucleotide
gguaauuggugauacuucu

SEQ ID NO: 12089 - RNA, 19 nt, Artificial Sequence
  Synthetic Oligonucleotide
cgacaagacauuggugagg

SEQ ID NO: 12090 - RNA, 19 nt, Artificial Sequence
  Synthetic Oligonucleotide
auagcaaucccuuuuauuu

SEQ ID NO: 12091 - RNA, 19 nt, Artificial Sequence
  Synthetic Oligonucleotide
guugguaaugccugauuca

SEQ ID NO: 12092 - RNA, 19 nt, Artificial Sequence
  Synthetic Oligonucleotide
uauuaacuguuaaaaagaa

SEQ ID NO: 12093 - RNA, 19 nt, Artificial Sequence
  Synthetic Oligonucleotide
ucaggaugaaaaauuuuga

SEQ ID NO: 12094 - RNA, 19 nt, Artificial Sequence
  Synthetic Oligonucleotide
ugggauagcaauaaccugu

SEQ ID NO: 12095 - RNA, 19 nt, Artificial Sequence
  Synthetic Oligonucleotide
aaaauuuugaaaccaguac

SEQ ID NO: 12096 - RNA, 19 nt, Artificial Sequence
  Synthetic Oligonucleotide
uggugauacuucuuugaau

SEQ ID NO: 12097 - RNA, 19 nt, Artificial Sequence
  Synthetic Oligonucleotide
aucaaugauuaugaacaac

SEQ ID NO: 12098 - RNA, 19 nt, Artificial Sequence
  Synthetic Oligonucleotide
uaagcucagguucaaagug

SEQ ID NO: 12099 - RNA, 19 nt, Artificial Sequence
  Synthetic Oligonucleotide
uaauuuguaucaaugauua

SEQ ID NO: 12100 - RNA, 19 nt, Artificial Sequence
  Synthetic Oligonucleotide
auuucauugcuuuugacuu

SEQ ID NO: 12101 - RNA, 19 nt, Artificial Sequence
  Synthetic Oligonucleotide
cugaauauauccaaauguu

SEQ ID NO: 12102 - RNA, 19 nt, Artificial Sequence
  Synthetic Oligonucleotide
ugauuaugaacaacaugcu

SEQ ID NO: 12103 - RNA, 19 nt, Artificial Sequence
  Synthetic Oligonucleotide
uauauuaacuguuaaaaag

SEQ ID NO: 12104 - RNA, 19 nt, Artificial Sequence
  Synthetic Oligonucleotide
uugguaaugccugauucac

SEQ ID NO: 12105 - RNA, 19 nt, Artificial Sequence
  Synthetic Oligonucleotide
ggaugaaaaauuuugaaac

SEQ ID NO: 12106 - RNA, 19 nt, Artificial Sequence
  Synthetic Oligonucleotide
uuugaaaccaguacuuuau

SEQ ID NO: 12107 - RNA, 19 nt, Artificial Sequence
  Synthetic Oligonucleotide
uccaaagucuauauaugac

SEQ ID NO: 12108 - RNA, 19 nt, Artificial Sequence
  Synthetic Oligonucleotide
acucaggaugaaaaauuuu

SEQ ID NO: 12109 - RNA, 19 nt, Artificial Sequence
  Synthetic Oligonucleotide
uauuaaccuguauucuguu

SEQ ID NO: 12110 - RNA, 19 nt, Artificial Sequence
  Synthetic Oligonucleotide
uucagcauguauuacuuga

SEQ ID NO: 12111 - RNA, 19 nt, Artificial Sequence
  Synthetic Oligonucleotide
acaauauuuucccaucugu

SEQ ID NO: 12112 - RNA, 19 nt, Artificial Sequence
  Synthetic Oligonucleotide
ucuguaauuccccacuuca

SEQ ID NO: 12113 - RNA, 19 nt, Artificial Sequence
  Synthetic Oligonucleotide
caaaguguugguaaugccu

SEQ ID NO: 12114 - RNA, 19 nt, Artificial Sequence
  Synthetic Oligonucleotide
aaagugcuguauccuuuag

SEQ ID NO: 12115 - RNA, 19 nt, Artificial Sequence
  Synthetic Oligonucleotide
acuuucauccuggaaauau

SEQ ID NO: 12116 - RNA, 19 nt, Artificial Sequence
  Synthetic Oligonucleotide
uggaugaugugcguaacag

SEQ ID NO: 12117 - RNA, 19 nt, Artificial Sequence
  Synthetic Oligonucleotide
gugaaagucaucgacaaga

SEQ ID NO: 12118 - RNA, 19 nt, Artificial Sequence
  Synthetic Oligonucleotide
cucaggaugaaaaauuuug

SEQ ID NO: 12119 - RNA, 19 nt, Artificial Sequence
  Synthetic Oligonucleotide
gaaauauauuaacuguuaa

SEQ ID NO: 12120 - RNA, 19 nt, Artificial Sequence
  Synthetic Oligonucleotide
uuuucagcauguauuacuu

SEQ ID NO: 12121 - RNA, 19 nt, Artificial Sequence
  Synthetic Oligonucleotide
uuucagcauguauuacuug

SEQ ID NO: 12122 - RNA, 19 nt, Artificial Sequence
  Synthetic Oligonucleotide
gcacaauauuuucccaucu

SEQ ID NO: 12123 - RNA, 19 nt, Artificial Sequence
  Synthetic Oligonucleotide
aaacacuaaggugaaaaga

SEQ ID NO: 12124 - RNA, 19 nt, Artificial Sequence
  Synthetic Oligonucleotide
gaaugugaaagucaucgac

SEQ ID NO: 12125 - RNA, 19 nt, Artificial Sequence
  Synthetic Oligonucleotide
gaaaaauuuugaaaccagu

SEQ ID NO: 12126 - RNA, 19 nt, Artificial Sequence
  Synthetic Oligonucleotide
uggacuuucauccuggaaa

SEQ ID NO: 12127 - RNA, 19 nt, Artificial Sequence
  Synthetic Oligonucleotide
aaauuguaagcucagguuc

SEQ ID NO: 12128 - RNA, 19 nt, Artificial Sequence
  Synthetic Oligonucleotide
auccuggaaauauauuaac

SEQ ID NO: 12129 - RNA, 19 nt, Artificial Sequence
  Synthetic Oligonucleotide
auauuaacuguuaaaaaga

SEQ ID NO: 12130 - RNA, 19 nt, Artificial Sequence
  Synthetic Oligonucleotide
aucccuuuuauuucauugc

SEQ ID NO: 12131 - RNA, 19 nt, Artificial Sequence
  Synthetic Oligonucleotide
uccaaauguuuuaggaugu

SEQ ID NO: 12132 - RNA, 19 nt, Artificial Sequence
  Synthetic Oligonucleotide
uguuaaaaagaaaacauug

SEQ ID NO: 12133 - RNA, 19 nt, Artificial Sequence
  Synthetic Oligonucleotide
gacugacaucauugccaau

SEQ ID NO: 12134 - RNA, 19 nt, Artificial Sequence
  Synthetic Oligonucleotide
uugaaaccaguacuuuauc

SEQ ID NO: 12135 - RNA, 19 nt, Artificial Sequence
  Synthetic Oligonucleotide
acuauugauguucugccag

SEQ ID NO: 12136 - RNA, 19 nt, Artificial Sequence
  Synthetic Oligonucleotide
aaauauauuaacuguuaaa

SEQ ID NO: 12137 - RNA, 19 nt, Artificial Sequence
  Synthetic Oligonucleotide
ucccuuuuauuucauugcu

SEQ ID NO: 12138 - RNA, 19 nt, Artificial Sequence
  Synthetic Oligonucleotide
ucucauuguuuauuaaccu

SEQ ID NO: 12139 - RNA, 19 nt, Artificial Sequence
  Synthetic Oligonucleotide
ggaugaugugcguaacaga

SEQ ID NO: 12140 - RNA, 19 nt, Artificial Sequence
  Synthetic Oligonucleotide
aaauggacuuucauccugg

SEQ ID NO: 12141 - RNA, 19 nt, Artificial Sequence
  Synthetic Oligonucleotide
auuuugaaaccaguacuuu

SEQ ID NO: 12142 - RNA, 19 nt, Artificial Sequence
  Synthetic Oligonucleotide
cacaacucaggaugaaaaa

SEQ ID NO: 12143 - RNA, 19 nt, Artificial Sequence
  Synthetic Oligonucleotide
gcauguauuacuugacaaa

SEQ ID NO: 12144 - RNA, 19 nt, Artificial Sequence
  Synthetic Oligonucleotide
uaaauuguaagcucagguu

SEQ ID NO: 12145 - RNA, 19 nt, Artificial Sequence
  Synthetic Oligonucleotide
uguuuauuaaccuguauuc

SEQ ID NO: 12146 - RNA, 19 nt, Artificial Sequence
  Synthetic Oligonucleotide
gaaaccaguacuuuaucau

SEQ ID NO: 12147 - RNA, 19 nt, Artificial Sequence
  Synthetic Oligonucleotide
agaaugugaaagucaucga

SEQ ID NO: 12148 - RNA, 19 nt, Artificial Sequence
  Synthetic Oligonucleotide
uaucaaugauuaugaacaa

SEQ ID NO: 12149 - RNA, 19 nt, Artificial Sequence
  Synthetic Oligonucleotide
auaaugaucucauuguuua

SEQ ID NO: 12150 - RNA, 19 nt, Artificial Sequence
  Synthetic Oligonucleotide
uguauucuguuuacauguc

SEQ ID NO: 12151 - RNA, 19 nt, Artificial Sequence
  Synthetic Oligonucleotide
aauauuuucccaucuguau

SEQ ID NO: 12152 - RNA, 19 nt, Artificial Sequence
  Synthetic Oligonucleotide
uagugucugaauauaucca

SEQ ID NO: 12153 - RNA, 19 nt, Artificial Sequence
  Synthetic Oligonucleotide
cacaauauuuucccaucug

SEQ ID NO: 12154 - RNA, 19 nt, Artificial Sequence
  Synthetic Oligonucleotide
ucguucuuuuccaacaaaa

SEQ ID NO: 12155 - RNA, 19 nt, Artificial Sequence
  Synthetic Oligonucleotide
ugacaucauugccaauugu

SEQ ID NO: 12156 - RNA, 19 nt, Artificial Sequence
  Synthetic Oligonucleotide
aguguugguaaugccugau

SEQ ID NO: 12157 - RNA, 19 nt, Artificial Sequence
  Synthetic Oligonucleotide
aagacugacaucauugcca

SEQ ID NO: 12158 - RNA, 19 nt, Artificial Sequence
  Synthetic Oligonucleotide
aaaagauaaugaucucauu

SEQ ID NO: 12159 - RNA, 19 nt, Artificial Sequence
  Synthetic Oligonucleotide
caacucaggaugaaaaauu

SEQ ID NO: 12160 - RNA, 19 nt, Artificial Sequence
  Synthetic Oligonucleotide
ugauaauauugcagcauuu

SEQ ID NO: 12161 - RNA, 19 nt, Artificial Sequence
  Synthetic Oligonucleotide
aaaccaguacuuuaucauu

SEQ ID NO: 12162 - RNA, 19 nt, Artificial Sequence
  Synthetic Oligonucleotide
caauauuuucccaucugua

SEQ ID NO: 12163 - RNA, 19 nt, Artificial Sequence
  Synthetic Oligonucleotide
ccaguacuuuaucauuuuc

SEQ ID NO: 12164 - RNA, 19 nt, Artificial Sequence
  Synthetic Oligonucleotide
ucaguacuuccaaagucua

SEQ ID NO: 12165 - RNA, 19 nt, Artificial Sequence
  Synthetic Oligonucleotide
acuaaggugaaaagauaau

SEQ ID NO: 12166 - RNA, 19 nt, Artificial Sequence
  Synthetic Oligonucleotide
aagcucagguucaaagugu

SEQ ID NO: 12167 - RNA, 19 nt, Artificial Sequence
  Synthetic Oligonucleotide
gcugagaagacugacauca

SEQ ID NO: 12168 - RNA, 19 nt, Artificial Sequence
  Synthetic Oligonucleotide
aggugaaaagauaaugauc

SEQ ID NO: 12169 - RNA, 19 nt, Artificial Sequence
  Synthetic Oligonucleotide
cagaaugugaaagucaucg

SEQ ID NO: 12170 - RNA, 19 nt, Artificial Sequence
  Synthetic Oligonucleotide
agcauguauuacuugacaa

SEQ ID NO: 12171 - RNA, 19 nt, Artificial Sequence
  Synthetic Oligonucleotide
ucauugcuuuugacuuuuc

SEQ ID NO: 12172 - RNA, 19 nt, Artificial Sequence
  Synthetic Oligonucleotide
cuaaggugaaaagauaaug

SEQ ID NO: 12173 - RNA, 19 nt, Artificial Sequence
  Synthetic Oligonucleotide
gccugauucacaacuuuga

SEQ ID NO: 12174 - RNA, 19 nt, Artificial Sequence
  Synthetic Oligonucleotide
gcaaucccuuuuauuucau

SEQ ID NO: 12175 - RNA, 19 nt, Artificial Sequence
  Synthetic Oligonucleotide
uuauuucauugcuuuugac

SEQ ID NO: 12176 - RNA, 19 nt, Artificial Sequence
  Synthetic Oligonucleotide
agucuguaauuccccacuu

SEQ ID NO: 12177 - RNA, 19 nt, Artificial Sequence
  Synthetic Oligonucleotide
gugauacuucuuugaaugu

SEQ ID NO: 12178 - RNA, 19 nt, Artificial Sequence
  Synthetic Oligonucleotide
ucaaugauuaugaacaaca

SEQ ID NO: 12179 - RNA, 19 nt, Artificial Sequence
  Synthetic Oligonucleotide
agugcuguauccuuuagua

SEQ ID NO: 12180 - RNA, 19 nt, Artificial Sequence
  Synthetic Oligonucleotide
ugucguucuuuuccaacaa

SEQ ID NO: 12181 - RNA, 19 nt, Artificial Sequence
  Synthetic Oligonucleotide
aacaaaauagcaaucccuu

SEQ ID NO: 12182 - RNA, 19 nt, Artificial Sequence
  Synthetic Oligonucleotide
gucuguaauuccccacuuc

SEQ ID NO: 12183 - RNA, 19 nt, Artificial Sequence
  Synthetic Oligonucleotide
gaaagucaucgacaagaca

SEQ ID NO: 12184 - RNA, 19 nt, Artificial Sequence
  Synthetic Oligonucleotide
guuuauuaaccuguauucu

SEQ ID NO: 12185 - RNA, 19 nt, Artificial Sequence
  Synthetic Oligonucleotide
uauguuacuucuuagagag

SEQ ID NO: 12186 - RNA, 19 nt, Artificial Sequence
  Synthetic Oligonucleotide
auccaaauguuuuaggaug

SEQ ID NO: 12187 - RNA, 19 nt, Artificial Sequence
  Synthetic Oligonucleotide
gguucuuaaauuguaagcu

SEQ ID NO: 12188 - RNA, 19 nt, Artificial Sequence
  Synthetic Oligonucleotide
ccaacaaaauagcaauccc

SEQ ID NO: 12189 - RNA, 19 nt, Artificial Sequence
  Synthetic Oligonucleotide
ugaacaacaugcuaaauca

SEQ ID NO: 12190 - RNA, 19 nt, Artificial Sequence
  Synthetic Oligonucleotide
caaacacuaaggugaaaag

SEQ ID NO: 12191 - RNA, 19 nt, Artificial Sequence
  Synthetic Oligonucleotide
cggcuaauuuguaucaaug

SEQ ID NO: 12192 - RNA, 19 nt, Artificial Sequence
  Synthetic Oligonucleotide
aauagcaaucccuuuuauu

SEQ ID NO: 12193 - RNA, 19 nt, Artificial Sequence
  Synthetic Oligonucleotide
auggacuuucauccuggaa

SEQ ID NO: 12194 - RNA, 19 nt, Artificial Sequence
  Synthetic Oligonucleotide
ggcugauaauauugcagca

SEQ ID NO: 12195 - RNA, 19 nt, Artificial Sequence
  Synthetic Oligonucleotide
caacaaaauagcaaucccu

SEQ ID NO: 12196 - RNA, 19 nt, Artificial Sequence
  Synthetic Oligonucleotide
aauguuuuaggauguaugu

SEQ ID NO: 12197 - RNA, 19 nt, Artificial Sequence
  Synthetic Oligonucleotide
uuagugucugaauauaucc

SEQ ID NO: 12198 - RNA, 19 nt, Artificial Sequence
  Synthetic Oligonucleotide
cccuuuuauuucauugcuu

SEQ ID NO: 12199 - RNA, 19 nt, Artificial Sequence
  Synthetic Oligonucleotide
ugucugaauauauccaaau

SEQ ID NO: 12200 - RNA, 19 nt, Artificial Sequence
  Synthetic Oligonucleotide
ccagaaugugaaagucauc

SEQ ID NO: 12201 - RNA, 19 nt, Artificial Sequence
  Synthetic Oligonucleotide
aaaaauuuugaaaccagua

SEQ ID NO: 12202 - RNA, 19 nt, Artificial Sequence
  Synthetic Oligonucleotide
uuuuucagcauguauuacu

SEQ ID NO: 12203 - RNA, 19 nt, Artificial Sequence
  Synthetic Oligonucleotide
gucugaauauauccaaaug

SEQ ID NO: 12204 - RNA, 19 nt, Artificial Sequence
  Synthetic Oligonucleotide
gaugaaaaauuuugaaacc

SEQ ID NO: 12205 - RNA, 19 nt, Artificial Sequence
  Synthetic Oligonucleotide
caggaugaaaaauuuugaa

SEQ ID NO: 12206 - RNA, 19 nt, Artificial Sequence
  Synthetic Oligonucleotide
ccaaagucuauauaugacu

SEQ ID NO: 12207 - RNA, 19 nt, Artificial Sequence
  Synthetic Oligonucleotide
agugucugaauauauccaa

SEQ ID NO: 12208 - RNA, 19 nt, Artificial Sequence
  Synthetic Oligonucleotide
aaugauuaugaacaacaug

SEQ ID NO: 12209 - RNA, 19 nt, Artificial Sequence
  Synthetic Oligonucleotide
guuaaaaagaaaacauuga

SEQ ID NO: 12210 - RNA, 19 nt, Artificial Sequence
  Synthetic Oligonucleotide
gugaaaagauaaugaucuc

SEQ ID NO: 12211 - RNA, 19 nt, Artificial Sequence
  Synthetic Oligonucleotide
gucguucuuuuccaacaaa

SEQ ID NO: 12212 - RNA, 19 nt, Artificial Sequence
  Synthetic Oligonucleotide
gugcuguauccuuuaguaa

SEQ ID NO: 12213 - RNA, 19 nt, Artificial Sequence
  Synthetic Oligonucleotide
aagugcuguauccuuuagu

SEQ ID NO: 12214 - RNA, 19 nt, Artificial Sequence
  Synthetic Oligonucleotide
aaagucuauauaugacuau

SEQ ID NO: 12215 - RNA, 19 nt, Artificial Sequence
  Synthetic Oligonucleotide
ucaaaguguugguaaugcc

SEQ ID NO: 12216 - RNA, 19 nt, Artificial Sequence
  Synthetic Oligonucleotide
cgguaauuggugauacuuc

SEQ ID NO: 12217 - RNA, 19 nt, Artificial Sequence
  Synthetic Oligonucleotide
ccaaauguuuuaggaugua

SEQ ID NO: 12218 - RNA, 19 nt, Artificial Sequence
  Synthetic Oligonucleotide
gauacuucuuugaauguag

SEQ ID NO: 12219 - RNA, 19 nt, Artificial Sequence
  Synthetic Oligonucleotide
ugaucucauuguuuauuaa

SEQ ID NO: 12220 - RNA, 19 nt, Artificial Sequence
  Synthetic Oligonucleotide
caaauguuuuaggauguau

SEQ ID NO: 12221 - RNA, 19 nt, Artificial Sequence
  Synthetic Oligonucleotide
ugagaagacugacaucauu

SEQ ID NO: 12222 - RNA, 19 nt, Artificial Sequence
  Synthetic Oligonucleotide
aacuguuaaaaagaaaaca

SEQ ID NO: 12223 - RNA, 19 nt, Artificial Sequence
  Synthetic Oligonucleotide
cuauugauguucugccaga

SEQ ID NO: 12224 - RNA, 19 nt, Artificial Sequence
  Synthetic Oligonucleotide
aaacagugguucuuaaauu

SEQ ID NO: 12225 - RNA, 19 nt, Artificial Sequence
  Synthetic Oligonucleotide
cuuucauccuggaaauaua

SEQ ID NO: 12226 - RNA, 19 nt, Artificial Sequence
  Synthetic Oligonucleotide
acuuuggcugauaauauug

SEQ ID NO: 12227 - RNA, 19 nt, Artificial Sequence
  Synthetic Oligonucleotide
uaucauuuucuccugagga

SEQ ID NO: 12228 - RNA, 19 nt, Artificial Sequence
  Synthetic Oligonucleotide
aaucaguacuuccaaaguc

SEQ ID NO: 12229 - RNA, 19 nt, Artificial Sequence
  Synthetic Oligonucleotide
cuuuuauuucauugcuuuu

SEQ ID NO: 12230 - RNA, 19 nt, Artificial Sequence
  Synthetic Oligonucleotide
gaaauggacuuucauccug

SEQ ID NO: 12231 - RNA, 19 nt, Artificial Sequence
  Synthetic Oligonucleotide
acuuccaaagucuauauau

SEQ ID NO: 12232 - RNA, 19 nt, Artificial Sequence
  Synthetic Oligonucleotide
gggugucguucuuuuccaa

SEQ ID NO: 12233 - RNA, 19 nt, Artificial Sequence
  Synthetic Oligonucleotide
aaggugaaaagauaaugau

SEQ ID NO: 12234 - RNA, 19 nt, Artificial Sequence
  Synthetic Oligonucleotide
guauuacuugacaaagaga

SEQ ID NO: 12235 - RNA, 19 nt, Artificial Sequence
  Synthetic Oligonucleotide
ugaugugcguaacagauuc

SEQ ID NO: 12236 - RNA, 19 nt, Artificial Sequence
  Synthetic Oligonucleotide
augaaaaauuuugaaacca

SEQ ID NO: 12237 - RNA, 19 nt, Artificial Sequence
  Synthetic Oligonucleotide
cugauaauauugcagcauu

SEQ ID NO: 12238 - RNA, 19 nt, Artificial Sequence
  Synthetic Oligonucleotide
cuggaugaugugcguaaca

SEQ ID NO: 12239 - RNA, 19 nt, Artificial Sequence
  Synthetic Oligonucleotide
ucgacaagacauuggugag

SEQ ID NO: 12240 - RNA, 19 nt, Artificial Sequence
  Synthetic Oligonucleotide
aaaguguugguaaugccug

SEQ ID NO: 12241 - RNA, 19 nt, Artificial Sequence
  Synthetic Oligonucleotide
aaauggcugagaagacuga

SEQ ID NO: 12242 - RNA, 19 nt, Artificial Sequence
  Synthetic Oligonucleotide
ugaagaaacuuuggcugau

SEQ ID NO: 12243 - RNA, 19 nt, Artificial Sequence
  Synthetic Oligonucleotide
gaaaagauaaugaucucau

SEQ ID NO: 12244 - RNA, 19 nt, Artificial Sequence
  Synthetic Oligonucleotide
uuguaucaaugauuaugaa

SEQ ID NO: 12245 - RNA, 19 nt, Artificial Sequence
  Synthetic Oligonucleotide
agacugacaucauugccaa

SEQ ID NO: 12246 - RNA, 19 nt, Artificial Sequence
  Synthetic Oligonucleotide
uagcaaacacuaaggugaa

SEQ ID NO: 12247 - RNA, 19 nt, Artificial Sequence
  Synthetic Oligonucleotide
gugccagaaugugaaaguc

SEQ ID NO: 12248 - RNA, 19 nt, Artificial Sequence
  Synthetic Oligonucleotide
gccacuauugauguucugc

SEQ ID NO: 12249 - RNA, 19 nt, Artificial Sequence
  Synthetic Oligonucleotide
uuuugaaaccaguacuuua

SEQ ID NO: 12250 - RNA, 19 nt, Artificial Sequence
  Synthetic Oligonucleotide
cuguaauuccccacuucaa

SEQ ID NO: 12251 - RNA, 19 nt, Artificial Sequence
  Synthetic Oligonucleotide
auagcaauaaccugugaaa

SEQ ID NO: 12252 - RNA, 19 nt, Artificial Sequence
  Synthetic Oligonucleotide
uaacuguuaaaaagaaaac

SEQ ID NO: 12253 - RNA, 19 nt, Artificial Sequence
  Synthetic Oligonucleotide
ccacaacucaggaugaaaa

SEQ ID NO: 12254 - RNA, 19 nt, Artificial Sequence
  Synthetic Oligonucleotide
cagguucaaaguguuggua

SEQ ID NO: 12255 - RNA, 19 nt, Artificial Sequence
  Synthetic Oligonucleotide
uaaccuguauucuguuuac

SEQ ID NO: 12256 - RNA, 19 nt, Artificial Sequence
  Synthetic Oligonucleotide
aaucacaucuuuagugucu

SEQ ID NO: 12257 - RNA, 19 nt, Artificial Sequence
  Synthetic Oligonucleotide
uguaagcucagguucaaag

SEQ ID NO: 12258 - RNA, 19 nt, Artificial Sequence
  Synthetic Oligonucleotide
ucuuugaauguagauuucc

SEQ ID NO: 12259 - RNA, 19 nt, Artificial Sequence
  Synthetic Oligonucleotide
cggaauguugcugaaacag

SEQ ID NO: 12260 - RNA, 19 nt, Artificial Sequence
  Synthetic Oligonucleotide
uuaacuguuaaaaagaaaa

SEQ ID NO: 12261 - RNA, 19 nt, Artificial Sequence
  Synthetic Oligonucleotide
aauauauuaacuguuaaaa

SEQ ID NO: 12262 - RNA, 19 nt, Artificial Sequence
  Synthetic Oligonucleotide
aaauguuuuaggauguaug

SEQ ID NO: 12263 - RNA, 19 nt, Artificial Sequence
  Synthetic Oligonucleotide
uuuguaucaaugauuauga

SEQ ID NO: 12264 - RNA, 19 nt, Artificial Sequence
  Synthetic Oligonucleotide
uuaaaacagugguucuuaa

SEQ ID NO: 12265 - RNA, 19 nt, Artificial Sequence
  Synthetic Oligonucleotide
aagaaacuuuggcugauaa

SEQ ID NO: 12266 - RNA, 19 nt, Artificial Sequence
  Synthetic Oligonucleotide
caagaucugacagugcaca

SEQ ID NO: 12267 - RNA, 19 nt, Artificial Sequence
  Synthetic Oligonucleotide
uaaggugaaaagauaauga

SEQ ID NO: 12268 - RNA, 19 nt, Artificial Sequence
  Synthetic Oligonucleotide
aauauugcagcauuuucca

SEQ ID NO: 12269 - RNA, 19 nt, Artificial Sequence
  Synthetic Oligonucleotide
guagcaaacacuaagguga

SEQ ID NO: 12270 - RNA, 19 nt, Artificial Sequence
  Synthetic Oligonucleotide
ugguaaugccugauucaca

SEQ ID NO: 12271 - RNA, 19 nt, Artificial Sequence
  Synthetic Oligonucleotide
augugaaagucaucgacaa

SEQ ID NO: 12272 - RNA, 19 nt, Artificial Sequence
  Synthetic Oligonucleotide
uaaaacagugguucuuaaa

SEQ ID NO: 12273 - RNA, 19 nt, Artificial Sequence
  Synthetic Oligonucleotide
cuguauucuguuuacaugu

SEQ ID NO: 12274 - RNA, 19 nt, Artificial Sequence
  Synthetic Oligonucleotide
gagaagacugacaucauug

SEQ ID NO: 12275 - RNA, 19 nt, Artificial Sequence
  Synthetic Oligonucleotide
cuuaaauuguaagcucagg

SEQ ID NO: 12276 - RNA, 19 nt, Artificial Sequence
  Synthetic Oligonucleotide
agcaaacacuaaggugaaa

SEQ ID NO: 12277 - RNA, 19 nt, Artificial Sequence
  Synthetic Oligonucleotide
ucagguucaaaguguuggu

SEQ ID NO: 12278 - RNA, 19 nt, Artificial Sequence
  Synthetic Oligonucleotide
acaagacauuggugaggaa

SEQ ID NO: 12279 - RNA, 19 nt, Artificial Sequence
  Synthetic Oligonucleotide
gguagcaaacacuaaggug

SEQ ID NO: 12280 - RNA, 19 nt, Artificial Sequence
  Synthetic Oligonucleotide
aaaacagugguucuuaaau

SEQ ID NO: 12281 - RNA, 19 nt, Artificial Sequence
  Synthetic Oligonucleotide
uucaaaguguugguaaugc

SEQ ID NO: 12282 - RNA, 19 nt, Artificial Sequence
  Synthetic Oligonucleotide
auuaaccuguauucuguuu

SEQ ID NO: 12283 - RNA, 19 nt, Artificial Sequence
  Synthetic Oligonucleotide
uguugguaaugccugauuc

SEQ ID NO: 12284 - RNA, 19 nt, Artificial Sequence
  Synthetic Oligonucleotide
caguacuuccaaagucuau

SEQ ID NO: 12285 - RNA, 19 nt, Artificial Sequence
  Synthetic Oligonucleotide
aguacuuccaaagucuaua

SEQ ID NO: 12286 - RNA, 19 nt, Artificial Sequence
  Synthetic Oligonucleotide
caaugauuaugaacaacau

SEQ ID NO: 12287 - RNA, 19 nt, Artificial Sequence
  Synthetic Oligonucleotide
guucaagauguccucgaga

SEQ ID NO: 12288 - RNA, 19 nt, Artificial Sequence
  Synthetic Oligonucleotide
uuuaaaacagugguucuua

SEQ ID NO: 12289 - RNA, 19 nt, Artificial Sequence
  Synthetic Oligonucleotide
aucucauuguuuauuaacc

SEQ ID NO: 12290 - RNA, 19 nt, Artificial Sequence
  Synthetic Oligonucleotide
guguugguaaugccugauu

SEQ ID NO: 12291 - RNA, 19 nt, Artificial Sequence
  Synthetic Oligonucleotide
caacaugcuaaaucaguac

SEQ ID NO: 12292 - RNA, 19 nt, Artificial Sequence
  Synthetic Oligonucleotide
ucuuaaauuguaagcucag

SEQ ID NO: 12293 - RNA, 19 nt, Artificial Sequence
  Synthetic Oligonucleotide
ucguuggcugcaacuguau

SEQ ID NO: 12294 - RNA, 19 nt, Artificial Sequence
  Synthetic Oligonucleotide
aaaucaguacuuccaaagu

SEQ ID NO: 12295 - RNA, 19 nt, Artificial Sequence
  Synthetic Oligonucleotide
caagacauuggugaggaaa

SEQ ID NO: 12296 - RNA, 19 nt, Artificial Sequence
  Synthetic Oligonucleotide
cauguauuacuugacaaag

SEQ ID NO: 12297 - RNA, 19 nt, Artificial Sequence
  Synthetic Oligonucleotide
ugauacuucuuugaaugua

SEQ ID NO: 12298 - RNA, 19 nt, Artificial Sequence
  Synthetic Oligonucleotide
aagaucugacagugcacaa

SEQ ID NO: 12299 - RNA, 19 nt, Artificial Sequence
  Synthetic Oligonucleotide
caucuuuagugucugaaua

SEQ ID NO: 12300 - RNA, 19 nt, Artificial Sequence
  Synthetic Oligonucleotide
gcaaacacuaaggugaaaa

SEQ ID NO: 12301 - RNA, 19 nt, Artificial Sequence
  Synthetic Oligonucleotide
uagcaauaaccugugaaaa

SEQ ID NO: 12302 - RNA, 19 nt, Artificial Sequence
  Synthetic Oligonucleotide
auauauuaacuguuaaaaa

SEQ ID NO: 12303 - RNA, 19 nt, Artificial Sequence
  Synthetic Oligonucleotide
gaugugcguaacagauuca

SEQ ID NO: 12304 - RNA, 19 nt, Artificial Sequence
  Synthetic Oligonucleotide
aucaguacuuccaaagucu

SEQ ID NO: 12305 - RNA, 19 nt, Artificial Sequence
  Synthetic Oligonucleotide
guaauuggugauacuucuu

SEQ ID NO: 12306 - RNA, 19 nt, Artificial Sequence
  Synthetic Oligonucleotide
uccaacaaaauagcaaucc

SEQ ID NO: 12307 - RNA, 19 nt, Artificial Sequence
  Synthetic Oligonucleotide
guaagcucagguucaaagu

SEQ ID NO: 12308 - RNA, 19 nt, Artificial Sequence
  Synthetic Oligonucleotide
ucugacagugcacaauauu

SEQ ID NO: 12309 - RNA, 19 nt, Artificial Sequence
  Synthetic Oligonucleotide
ugcagcauuuuccagaugg

SEQ ID NO: 12310 - RNA, 19 nt, Artificial Sequence
  Synthetic Oligonucleotide
ugguucuuaaauuguaagc

SEQ ID NO: 12311 - RNA, 19 nt, Artificial Sequence
  Synthetic Oligonucleotide
gaugaagaaacuuuggcug

SEQ ID NO: 12312 - RNA, 19 nt, Artificial Sequence
  Synthetic Oligonucleotide
aacacuaaggugaaaagau

SEQ ID NO: 12313 - RNA, 19 nt, Artificial Sequence
  Synthetic Oligonucleotide
uuguuuauuaaccuguauu

SEQ ID NO: 12314 - RNA, 19 nt, Artificial Sequence
  Synthetic Oligonucleotide
gccacaacucaggaugaaa

SEQ ID NO: 12315 - RNA, 19 nt, Artificial Sequence
  Synthetic Oligonucleotide
gaaacuuuggcugauaaua

SEQ ID NO: 12316 - RNA, 19 nt, Artificial Sequence
  Synthetic Oligonucleotide
ugcacaauauuuucccauc

SEQ ID NO: 12317 - RNA, 19 nt, Artificial Sequence
  Synthetic Oligonucleotide
ugaaagucaucgacaagac

SEQ ID NO: 12318 - RNA, 19 nt, Artificial Sequence
  Synthetic Oligonucleotide
auuaugaacaacaugcuaa

SEQ ID NO: 12319 - RNA, 19 nt, Artificial Sequence
  Synthetic Oligonucleotide
ccuguauucuguuuacaug

SEQ ID NO: 12320 - RNA, 19 nt, Artificial Sequence
  Synthetic Oligonucleotide
gauaauauugcagcauuuu

SEQ ID NO: 12321 - RNA, 19 nt, Artificial Sequence
  Synthetic Oligonucleotide
uauuuucccaucuguauua

SEQ ID NO: 12322 - RNA, 19 nt, Artificial Sequence
  Synthetic Oligonucleotide
guauguuacuucuuagaga

SEQ ID NO: 12323 - RNA, 19 nt, Artificial Sequence
  Synthetic Oligonucleotide
caucgacaagacauuggug

SEQ ID NO: 12324 - RNA, 19 nt, Artificial Sequence
  Synthetic Oligonucleotide
gcucagguucaaaguguug

SEQ ID NO: 12325 - RNA, 19 nt, Artificial Sequence
  Synthetic Oligonucleotide
uguauuacuugacaaagag

SEQ ID NO: 12326 - RNA, 19 nt, Artificial Sequence
  Synthetic Oligonucleotide
auguauuacuugacaaaga

SEQ ID NO: 12327 - RNA, 19 nt, Artificial Sequence
  Synthetic Oligonucleotide
gugucguucuuuuccaaca

SEQ ID NO: 12328 - RNA, 19 nt, Artificial Sequence
  Synthetic Oligonucleotide
caaagucuauauaugacua

SEQ ID NO: 12329 - RNA, 19 nt, Artificial Sequence
  Synthetic Oligonucleotide
agguagcaaacacuaaggu

SEQ ID NO: 12330 - RNA, 19 nt, Artificial Sequence
  Synthetic Oligonucleotide
uaucaaauggcugagaaga

SEQ ID NO: 12331 - RNA, 19 nt, Artificial Sequence
  Synthetic Oligonucleotide
aaccaguacuuuaucauuu

SEQ ID NO: 12332 - RNA, 19 nt, Artificial Sequence
  Synthetic Oligonucleotide
guaaugccugauucacaac

SEQ ID NO: 12333 - RNA, 19 nt, Artificial Sequence
  Synthetic Oligonucleotide
cacuauugauguucugcca

SEQ ID NO: 12334 - RNA, 19 nt, Artificial Sequence
  Synthetic Oligonucleotide
uuuauuaaccuguauucug

SEQ ID NO: 12335 - RNA, 19 nt, Artificial Sequence
  Synthetic Oligonucleotide
uauugauguucugccagaa

SEQ ID NO: 12336 - RNA, 19 nt, Artificial Sequence
  Synthetic Oligonucleotide
aggaugaaaaauuuugaaa

SEQ ID NO: 12337 - RNA, 19 nt, Artificial Sequence
  Synthetic Oligonucleotide
aucauuuucuccugaggaa

SEQ ID NO: 12338 - RNA, 19 nt, Artificial Sequence
  Synthetic Oligonucleotide
gguaaugccugauucacaa

SEQ ID NO: 12339 - RNA, 19 nt, Artificial Sequence
  Synthetic Oligonucleotide
accuguauucuguuuacau

SEQ ID NO: 12340 - RNA, 19 nt, Artificial Sequence
  Synthetic Oligonucleotide
agucaucgacaagacauug

SEQ ID NO: 12341 - RNA, 19 nt, Artificial Sequence
  Synthetic Oligonucleotide
gaagaaacuuuggcugaua

SEQ ID NO: 12342 - RNA, 19 nt, Artificial Sequence
  Synthetic Oligonucleotide
cagugguucuuaaauugua

SEQ ID NO: 12343 - RNA, 19 nt, Artificial Sequence
  Synthetic Oligonucleotide
auauauccaaauguuuuag

SEQ ID NO: 12344 - RNA, 19 nt, Artificial Sequence
  Synthetic Oligonucleotide
aagacauuggugaggaaaa

SEQ ID NO: 12345 - RNA, 19 nt, Artificial Sequence
  Synthetic Oligonucleotide
cugacagugcacaauauuu

SEQ ID NO: 12346 - RNA, 19 nt, Artificial Sequence
  Synthetic Oligonucleotide
ugccagaaugugaaaguca

SEQ ID NO: 12347 - RNA, 19 nt, Artificial Sequence
  Synthetic Oligonucleotide
gaauguagauuuccaauca

SEQ ID NO: 12348 - RNA, 19 nt, Artificial Sequence
  Synthetic Oligonucleotide
cuguuaaaaagaaaacauu

SEQ ID NO: 12349 - RNA, 19 nt, Artificial Sequence
  Synthetic Oligonucleotide
augaacaacaugcuaaauc

SEQ ID NO: 12350 - RNA, 19 nt, Artificial Sequence
  Synthetic Oligonucleotide
guaucaaugauuaugaaca

SEQ ID NO: 12351 - RNA, 19 nt, Artificial Sequence
  Synthetic Oligonucleotide
uauucuguuuacaugucuu

SEQ ID NO: 12352 - RNA, 19 nt, Artificial Sequence
  Synthetic Oligonucleotide
aacucaggaugaaaaauuu

SEQ ID NO: 12353 - RNA, 19 nt, Artificial Sequence
  Synthetic Oligonucleotide
uauccaaauguuuuaggau

SEQ ID NO: 12354 - RNA, 19 nt, Artificial Sequence
  Synthetic Oligonucleotide
gcgguaauuggugauacuu

SEQ ID NO: 12355 - RNA, 19 nt, Artificial Sequence
  Synthetic Oligonucleotide
augaagaaacuuuggcuga

SEQ ID NO: 12356 - RNA, 19 nt, Artificial Sequence
  Synthetic Oligonucleotide
uucauugcuuuugacuuuu

SEQ ID NO: 12357 - RNA, 19 nt, Artificial Sequence
  Synthetic Oligonucleotide
gugucugaauauauccaaa

SEQ ID NO: 12358 - RNA, 19 nt, Artificial Sequence
  Synthetic Oligonucleotide
auuguuuauuaaccuguau

SEQ ID NO: 12359 - RNA, 19 nt, Artificial Sequence
  Synthetic Oligonucleotide
uauauccaaauguuuuagg

SEQ ID NO: 12360 - RNA, 19 nt, Artificial Sequence
  Synthetic Oligonucleotide
acagugcacaauauuuucc

SEQ ID NO: 12361 - RNA, 19 nt, Artificial Sequence
  Synthetic Oligonucleotide
aaccuguauucuguuuaca

SEQ ID NO: 12362 - RNA, 19 nt, Artificial Sequence
  Synthetic Oligonucleotide
aaugccugauucacaacuu

SEQ ID NO: 12363 - RNA, 19 nt, Artificial Sequence
  Synthetic Oligonucleotide
auugauguucugccagaaa

SEQ ID NO: 12364 - RNA, 19 nt, Artificial Sequence
  Synthetic Oligonucleotide
ugaauguagauuuccaauc

SEQ ID NO: 12365 - RNA, 19 nt, Artificial Sequence
  Synthetic Oligonucleotide
ccuuuuauuucauugcuuu

SEQ ID NO: 12366 - RNA, 19 nt, Artificial Sequence
  Synthetic Oligonucleotide
gccagaaugugaaagucau

SEQ ID NO: 12367 - RNA, 19 nt, Artificial Sequence
  Synthetic Oligonucleotide
aaugugaaagucaucgaca

SEQ ID NO: 12368 - RNA, 19 nt, Artificial Sequence
  Synthetic Oligonucleotide
gaugaugugcguaacagau

SEQ ID NO: 12369 - RNA, 19 nt, Artificial Sequence
  Synthetic Oligonucleotide
agcucagguucaaaguguu

SEQ ID NO: 12370 - RNA, 19 nt, Artificial Sequence
  Synthetic Oligonucleotide
auucuguuuacaugucuuu

SEQ ID NO: 12371 - RNA, 19 nt, Artificial Sequence
  Synthetic Oligonucleotide
gacaagacauuggugagga

SEQ ID NO: 12372 - RNA, 19 nt, Artificial Sequence
  Synthetic Oligonucleotide
aguaaaauuggagguagca

SEQ ID NO: 12373 - RNA, 19 nt, Artificial Sequence
  Synthetic Oligonucleotide
guacuuccaaagucuauau

SEQ ID NO: 12374 - RNA, 19 nt, Artificial Sequence
  Synthetic Oligonucleotide
aauguagauuuccaaucac

SEQ ID NO: 12375 - RNA, 19 nt, Artificial Sequence
  Synthetic Oligonucleotide
ccaagaucugacagugcac

SEQ ID NO: 12376 - RNA, 19 nt, Artificial Sequence
  Synthetic Oligonucleotide
uacuucuuugaauguagau

SEQ ID NO: 12377 - RNA, 19 nt, Artificial Sequence
  Synthetic Oligonucleotide
gcugauaauauugcagcau

SEQ ID NO: 12378 - RNA, 19 nt, Artificial Sequence
  Synthetic Oligonucleotide
ugcuaaaucaguacuucca

SEQ ID NO: 12379 - RNA, 19 nt, Artificial Sequence
  Synthetic Oligonucleotide
agagagaaauaaagcauuu

SEQ ID NO: 12380 - RNA, 19 nt, Artificial Sequence
  Synthetic Oligonucleotide
aauauauccaaauguuuua

SEQ ID NO: 12381 - RNA, 19 nt, Artificial Sequence
  Synthetic Oligonucleotide
uuuauuucauugcuuuuga

SEQ ID NO: 12382 - RNA, 19 nt, Artificial Sequence
  Synthetic Oligonucleotide
cagugcacaauauuuuccc

SEQ ID NO: 12383 - RNA, 19 nt, Artificial Sequence
  Synthetic Oligonucleotide
ucacaucuuuagugucuga

SEQ ID NO: 12384 - RNA, 19 nt, Artificial Sequence
  Synthetic Oligonucleotide
uguauguuacuucuuagag

SEQ ID NO: 12385 - RNA, 19 nt, Artificial Sequence
  Synthetic Oligonucleotide
uaggaaccuuuuagaaaga

SEQ ID NO: 12386 - RNA, 19 nt, Artificial Sequence
  Synthetic Oligonucleotide
uguucaagauguccucgag

SEQ ID NO: 12387 - RNA, 19 nt, Artificial Sequence
  Synthetic Oligonucleotide
ccggcuaauuuguaucaau

SEQ ID NO: 12388 - RNA, 19 nt, Artificial Sequence
  Synthetic Oligonucleotide
aagggugucguucuuuucc

SEQ ID NO: 12389 - RNA, 19 nt, Artificial Sequence
  Synthetic Oligonucleotide
accuuuuagaaagaaaugg

SEQ ID NO: 12390 - RNA, 19 nt, Artificial Sequence
  Synthetic Oligonucleotide
cauugcuuuugacuuuuca

SEQ ID NO: 12391 - RNA, 19 nt, Artificial Sequence
  Synthetic Oligonucleotide
ucaaauggcugagaagacu

SEQ ID NO: 12392 - RNA, 19 nt, Artificial Sequence
  Synthetic Oligonucleotide
cguucuuuuccaacaaaau

SEQ ID NO: 12393 - RNA, 19 nt, Artificial Sequence
  Synthetic Oligonucleotide
ggugucguucuuuuccaac

SEQ ID NO: 12394 - RNA, 19 nt, Artificial Sequence
  Synthetic Oligonucleotide
uuauuaaccuguauucugu

SEQ ID NO: 12395 - RNA, 19 nt, Artificial Sequence
  Synthetic Oligonucleotide
uuaaauuguaagcucaggu

SEQ ID NO: 12396 - RNA, 19 nt, Artificial Sequence
  Synthetic Oligonucleotide
ggcugagaagacugacauc

SEQ ID NO: 12397 - RNA, 19 nt, Artificial Sequence
  Synthetic Oligonucleotide
ccggaauguugcugaaaca

SEQ ID NO: 12398 - RNA, 19 nt, Artificial Sequence
  Synthetic Oligonucleotide
gaauauauccaaauguuuu

SEQ ID NO: 12399 - RNA, 19 nt, Artificial Sequence
  Synthetic Oligonucleotide
acagucuguaauuccccac

SEQ ID NO: 12400 - RNA, 19 nt, Artificial Sequence
  Synthetic Oligonucleotide
uggcugcaacuguauaucu

SEQ ID NO: 12401 - RNA, 19 nt, Artificial Sequence
  Synthetic Oligonucleotide
auuaacuguuaaaaagaaa

SEQ ID NO: 12402 - RNA, 19 nt, Artificial Sequence
  Synthetic Oligonucleotide
ugaugaagaaacuuuggcu

SEQ ID NO: 12403 - RNA, 19 nt, Artificial Sequence
  Synthetic Oligonucleotide
acaacaugcuaaaucagua

SEQ ID NO: 12404 - RNA, 19 nt, Artificial Sequence
  Synthetic Oligonucleotide
uuggugauacuucuuugaa

SEQ ID NO: 12405 - RNA, 19 nt, Artificial Sequence
  Synthetic Oligonucleotide
gauucacaacuuugagaag

SEQ ID NO: 12406 - RNA, 19 nt, Artificial Sequence
  Synthetic Oligonucleotide
uuucauugcuuuugacuuu

SEQ ID NO: 12407 - RNA, 19 nt, Artificial Sequence
  Synthetic Oligonucleotide
auuuuccagauggaagcug

SEQ ID NO: 12408 - RNA, 19 nt, Artificial Sequence
  Synthetic Oligonucleotide
guauucuguuuacaugucu

SEQ ID NO: 12409 - RNA, 19 nt, Artificial Sequence
  Synthetic Oligonucleotide
acuugacaaagagacacug

SEQ ID NO: 12410 - RNA, 19 nt, Artificial Sequence
  Synthetic Oligonucleotide
gguucaaaguguugguaau

SEQ ID NO: 12411 - RNA, 19 nt, Artificial Sequence
  Synthetic Oligonucleotide
acuguuaaaaagaaaacau

SEQ ID NO: 12412 - RNA, 19 nt, Artificial Sequence
  Synthetic Oligonucleotide
aauacaaagggugucguuc

SEQ ID NO: 12413 - RNA, 19 nt, Artificial Sequence
  Synthetic Oligonucleotide
acuuuaucauuuucuccug

SEQ ID NO: 12414 - RNA, 19 nt, Artificial Sequence
  Synthetic Oligonucleotide
cuuuaaaacagugguucuu

SEQ ID NO: 12415 - RNA, 19 nt, Artificial Sequence
  Synthetic Oligonucleotide
ccaaucacaucuuuagugu

SEQ ID NO: 12416 - RNA, 19 nt, Artificial Sequence
  Synthetic Oligonucleotide
uuccaaagucuauauauga

SEQ ID NO: 12417 - RNA, 19 nt, Artificial Sequence
  Synthetic Oligonucleotide
uuaucauuuucuccugagg

SEQ ID NO: 12418 - RNA, 19 nt, Artificial Sequence
  Synthetic Oligonucleotide
auguuacuucuuagagaga

SEQ ID NO: 12419 - RNA, 19 nt, Artificial Sequence
  Synthetic Oligonucleotide
aguacuuuaucauuuucuc

SEQ ID NO: 12420 - RNA, 19 nt, Artificial Sequence
  Synthetic Oligonucleotide
aucugacagugcacaauau

SEQ ID NO: 12421 - RNA, 19 nt, Artificial Sequence
  Synthetic Oligonucleotide
caagauguccucgagauac

SEQ ID NO: 12422 - RNA, 19 nt, Artificial Sequence
  Synthetic Oligonucleotide
uacuugacaaagagacacu

SEQ ID NO: 12423 - RNA, 19 nt, Artificial Sequence
  Synthetic Oligonucleotide
augccugauucacaacuuu

SEQ ID NO: 12424 - RNA, 19 nt, Artificial Sequence
  Synthetic Oligonucleotide
uuaugaacaacaugcuaaa

SEQ ID NO: 12425 - RNA, 19 nt, Artificial Sequence
  Synthetic Oligonucleotide
auuguaagcucagguucaa

SEQ ID NO: 12426 - RNA, 19 nt, Artificial Sequence
  Synthetic Oligonucleotide
agaaauggacuuucauccu

SEQ ID NO: 12427 - RNA, 19 nt, Artificial Sequence
  Synthetic Oligonucleotide
uaaagugcuguauccuuua

SEQ ID NO: 12428 - RNA, 19 nt, Artificial Sequence
  Synthetic Oligonucleotide
gagugggugccagaaugug

SEQ ID NO: 12429 - RNA, 19 nt, Artificial Sequence
  Synthetic Oligonucleotide
ggauguauguuacuucuua

SEQ ID NO: 12430 - RNA, 19 nt, Artificial Sequence
  Synthetic Oligonucleotide
ugugaaagucaucgacaag

SEQ ID NO: 12431 - RNA, 19 nt, Artificial Sequence
  Synthetic Oligonucleotide
aagauaucaaauggcugag

SEQ ID NO: 12432 - RNA, 19 nt, Artificial Sequence
  Synthetic Oligonucleotide
uucuguuuacaugucuuua

SEQ ID NO: 12433 - RNA, 19 nt, Artificial Sequence
  Synthetic Oligonucleotide
acacuaaggugaaaagaua

SEQ ID NO: 12434 - RNA, 19 nt, Artificial Sequence
  Synthetic Oligonucleotide
agucuauauaugacuauua

SEQ ID NO: 12435 - RNA, 19 nt, Artificial Sequence
  Synthetic Oligonucleotide
uacuuuaucauuuucuccu

SEQ ID NO: 12436 - RNA, 19 nt, Artificial Sequence
  Synthetic Oligonucleotide
gcagcauuuuccagaugga

SEQ ID NO: 12437 - RNA, 19 nt, Artificial Sequence
  Synthetic Oligonucleotide
aucuuuagugucugaauau

SEQ ID NO: 12438 - RNA, 19 nt, Artificial Sequence
  Synthetic Oligonucleotide
ggugccagaaugugaaagu

SEQ ID NO: 12439 - RNA, 19 nt, Artificial Sequence
  Synthetic Oligonucleotide
auguauguuacuucuuaga

SEQ ID NO: 12440 - RNA, 19 nt, Artificial Sequence
  Synthetic Oligonucleotide
aauggcugagaagacugac

SEQ ID NO: 12441 - RNA, 19 nt, Artificial Sequence
  Synthetic Oligonucleotide
acaucuuuagugucugaau

SEQ ID NO: 12442 - RNA, 19 nt, Artificial Sequence
  Synthetic Oligonucleotide
agaaacuuuggcugauaau

SEQ ID NO: 12443 - RNA, 19 nt, Artificial Sequence
  Synthetic Oligonucleotide
aagauguccucgagauacu

SEQ ID NO: 12444 - RNA, 19 nt, Artificial Sequence
  Synthetic Oligonucleotide
ucaucgacaagacauuggu

SEQ ID NO: 12445 - RNA, 19 nt, Artificial Sequence
  Synthetic Oligonucleotide
agaucugacagugcacaau

SEQ ID NO: 12446 - RNA, 19 nt, Artificial Sequence
  Synthetic Oligonucleotide
ugccugauucacaacuuug

SEQ ID NO: 12447 - RNA, 19 nt, Artificial Sequence
  Synthetic Oligonucleotide
gcugcauauguggcuaaag

SEQ ID NO: 12448 - RNA, 19 nt, Artificial Sequence
  Synthetic Oligonucleotide
aggaaccuuuuagaaagaa

SEQ ID NO: 12449 - RNA, 19 nt, Artificial Sequence
  Synthetic Oligonucleotide
guucaaaguguugguaaug

SEQ ID NO: 12450 - RNA, 19 nt, Artificial Sequence
  Synthetic Oligonucleotide
ugcuguauccuuuaguaaa

SEQ ID NO: 12451 - RNA, 19 nt, Artificial Sequence
  Synthetic Oligonucleotide
cgccacaacucaggaugaa

SEQ ID NO: 12452 - RNA, 19 nt, Artificial Sequence
  Synthetic Oligonucleotide
cacaucuuuagugucugaa

SEQ ID NO: 12453 - RNA, 19 nt, Artificial Sequence
  Synthetic Oligonucleotide
agguucaaaguguugguaa

SEQ ID NO: 12454 - RNA, 19 nt, Artificial Sequence
  Synthetic Oligonucleotide
cauuuucuccugaggaaaa

SEQ ID NO: 12455 - RNA, 19 nt, Artificial Sequence
  Synthetic Oligonucleotide
cguuggcugcaacuguaua

SEQ ID NO: 12456 - RNA, 19 nt, Artificial Sequence
  Synthetic Oligonucleotide
acuucguuggcugcaacug

SEQ ID NO: 12457 - RNA, 19 nt, Artificial Sequence
  Synthetic Oligonucleotide
uuuuauuucauugcuuuug

SEQ ID NO: 12458 - RNA, 19 nt, Artificial Sequence
  Synthetic Oligonucleotide
auauuuucccaucuguauu

SEQ ID NO: 12459 - RNA, 19 nt, Artificial Sequence
  Synthetic Oligonucleotide
gacaucauugccaauuguu

SEQ ID NO: 12460 - RNA, 19 nt, Artificial Sequence
  Synthetic Oligonucleotide
agaaauaaagcauuuuugg

SEQ ID NO: 12461 - RNA, 19 nt, Artificial Sequence
  Synthetic Oligonucleotide
cagucuguaauuccccacu

SEQ ID NO: 12462 - RNA, 19 nt, Artificial Sequence
  Synthetic Oligonucleotide
cugagaagacugacaucau

SEQ ID NO: 12463 - RNA, 19 nt, Artificial Sequence
  Synthetic Oligonucleotide
ucuuuuccaacaaaauagc

SEQ ID NO: 12464 - RNA, 19 nt, Artificial Sequence
  Synthetic Oligonucleotide
ccacuauugauguucugcc

SEQ ID NO: 12465 - RNA, 19 nt, Artificial Sequence
  Synthetic Oligonucleotide
aacaacaugcuaaaucagu

SEQ ID NO: 12466 - RNA, 19 nt, Artificial Sequence
  Synthetic Oligonucleotide
ccuuuaguaaaauuggagg

SEQ ID NO: 12467 - RNA, 19 nt, Artificial Sequence
  Synthetic Oligonucleotide
gcuuuugacuuuucaaugg

SEQ ID NO: 12468 - RNA, 19 nt, Artificial Sequence
  Synthetic Oligonucleotide
ccuuuuagaaagaaaugga

SEQ ID NO: 12469 - RNA, 19 nt, Artificial Sequence
  Synthetic Oligonucleotide
caaucacaucuuuaguguc

SEQ ID NO: 12470 - RNA, 19 nt, Artificial Sequence
  Synthetic Oligonucleotide
auauugcagcauuuuccag

SEQ ID NO: 12471 - RNA, 19 nt, Artificial Sequence
  Synthetic Oligonucleotide
uuggcugcaacuguauauc

SEQ ID NO: 12472 - RNA, 19 nt, Artificial Sequence
  Synthetic Oligonucleotide
auuacuugacaaagagaca

SEQ ID NO: 12473 - RNA, 19 nt, Artificial Sequence
  Synthetic Oligonucleotide
caucuaucagcugggaaga

SEQ ID NO: 12474 - RNA, 19 nt, Artificial Sequence
  Synthetic Oligonucleotide
uuuagugucugaauauauc

SEQ ID NO: 12475 - RNA, 19 nt, Artificial Sequence
  Synthetic Oligonucleotide
aucacaucuuuagugucug

SEQ ID NO: 12476 - RNA, 19 nt, Artificial Sequence
  Synthetic Oligonucleotide
caaucccuuuuauuucauu

SEQ ID NO: 12477 - RNA, 19 nt, Artificial Sequence
  Synthetic Oligonucleotide
ucuuuagugucugaauaua

SEQ ID NO: 12478 - RNA, 19 nt, Artificial Sequence
  Synthetic Oligonucleotide
uuaaccuguauucuguuua

SEQ ID NO: 12479 - RNA, 19 nt, Artificial Sequence
  Synthetic Oligonucleotide
acaucauugccaauuguug

SEQ ID NO: 12480 - RNA, 19 nt, Artificial Sequence
  Synthetic Oligonucleotide
aaagggugucguucuuuuc

SEQ ID NO: 12481 - RNA, 19 nt, Artificial Sequence
  Synthetic Oligonucleotide
guccucgagauacuaaagg

SEQ ID NO: 12482 - RNA, 19 nt, Artificial Sequence
  Synthetic Oligonucleotide
guuacuucuuagagagaaa

SEQ ID NO: 12483 - RNA, 19 nt, Artificial Sequence
  Synthetic Oligonucleotide
uacaaagggugucguucuu

SEQ ID NO: 12484 - RNA, 19 nt, Artificial Sequence
  Synthetic Oligonucleotide
uaggauguauguuacuucu

SEQ ID NO: 12485 - RNA, 19 nt, Artificial Sequence
  Synthetic Oligonucleotide
uggcugauaauauugcagc

SEQ ID NO: 12486 - RNA, 19 nt, Artificial Sequence
  Synthetic Oligonucleotide
uccaagaucugacagugca

SEQ ID NO: 12487 - RNA, 19 nt, Artificial Sequence
  Synthetic Oligonucleotide
caaauggcugagaagacug

SEQ ID NO: 12488 - RNA, 19 nt, Artificial Sequence
  Synthetic Oligonucleotide
cuuccaaagucuauauaug

SEQ ID NO: 12489 - RNA, 19 nt, Artificial Sequence
  Synthetic Oligonucleotide
uagagagaaauaaagcauu

SEQ ID NO: 12490 - RNA, 19 nt, Artificial Sequence
  Synthetic Oligonucleotide
uuacuucuuagagagaaau

SEQ ID NO: 12491 - RNA, 19 nt, Artificial Sequence
  Synthetic Oligonucleotide
gggugccagaaugugaaag

SEQ ID NO: 12492 - RNA, 19 nt, Artificial Sequence
  Synthetic Oligonucleotide
cucagguucaaaguguugg

SEQ ID NO: 12493 - RNA, 19 nt, Artificial Sequence
  Synthetic Oligonucleotide
gaagguagcacuggagaga

SEQ ID NO: 12494 - RNA, 19 nt, Artificial Sequence
  Synthetic Oligonucleotide
cacuaaggugaaaagauaa

SEQ ID NO: 12495 - RNA, 19 nt, Artificial Sequence
  Synthetic Oligonucleotide
uaauauugcagcauuuucc

SEQ ID NO: 12496 - RNA, 19 nt, Artificial Sequence
  Synthetic Oligonucleotide
aagaaauggacuuucaucc

SEQ ID NO: 12497 - RNA, 19 nt, Artificial Sequence
  Synthetic Oligonucleotide
cuuagagagaaauaaagca

SEQ ID NO: 12498 - RNA, 19 nt, Artificial Sequence
  Synthetic Oligonucleotide
gugguucuuaaauuguaag

SEQ ID NO: 12499 - RNA, 19 nt, Artificial Sequence
  Synthetic Oligonucleotide
uuuaucauuuucuccugag

SEQ ID NO: 12500 - RNA, 19 nt, Artificial Sequence
  Synthetic Oligonucleotide
auacuucuuugaauguaga

SEQ ID NO: 12501 - RNA, 19 nt, Artificial Sequence
  Synthetic Oligonucleotide
uucuuaaauuguaagcuca

SEQ ID NO: 12502 - RNA, 19 nt, Artificial Sequence
  Synthetic Oligonucleotide
caugcuaaaucaguacuuc

SEQ ID NO: 12503 - RNA, 19 nt, Artificial Sequence
  Synthetic Oligonucleotide
gaauguugcugaaacagau

SEQ ID NO: 12504 - RNA, 19 nt, Artificial Sequence
  Synthetic Oligonucleotide
uuguaagcucagguucaaa

SEQ ID NO: 12505 - RNA, 19 nt, Artificial Sequence
  Synthetic Oligonucleotide
gaucugucgacuucuguuu

SEQ ID NO: 12506 - RNA, 19 nt, Artificial Sequence
  Synthetic Oligonucleotide
uacaaggccauauuuguga

SEQ ID NO: 12507 - RNA, 19 nt, Artificial Sequence
  Synthetic Oligonucleotide
acaugucuuuaaaacagug

SEQ ID NO: 12508 - RNA, 19 nt, Artificial Sequence
  Synthetic Oligonucleotide
uaauuccccacuucaauac

SEQ ID NO: 12509 - RNA, 19 nt, Artificial Sequence
  Synthetic Oligonucleotide
ucuggaugaugugcguaac

SEQ ID NO: 12510 - RNA, 19 nt, Artificial Sequence
  Synthetic Oligonucleotide
ggagguagcaaacacuaag

SEQ ID NO: 12511 - RNA, 19 nt, Artificial Sequence
  Synthetic Oligonucleotide
ucuuagagagaaauaaagc

SEQ ID NO: 12512 - RNA, 19 nt, Artificial Sequence
  Synthetic Oligonucleotide
uguuuuaggauguauguua

SEQ ID NO: 12513 - RNA, 19 nt, Artificial Sequence
  Synthetic Oligonucleotide
uguccucgagauacuaaag

SEQ ID NO: 12514 - RNA, 19 nt, Artificial Sequence
  Synthetic Oligonucleotide
ccugauucacaacuuugag

SEQ ID NO: 12515 - RNA, 19 nt, Artificial Sequence
  Synthetic Oligonucleotide
ucuguuuacaugucuuuaa

SEQ ID NO: 12516 - RNA, 19 nt, Artificial Sequence
  Synthetic Oligonucleotide
agauaucaaauggcugaga

SEQ ID NO: 12517 - RNA, 19 nt, Artificial Sequence
  Synthetic Oligonucleotide
uuggcugauaauauugcag

SEQ ID NO: 12518 - RNA, 19 nt, Artificial Sequence
  Synthetic Oligonucleotide
ccagauggaagcuguaucc

SEQ ID NO: 12519 - RNA, 19 nt, Artificial Sequence
  Synthetic Oligonucleotide
cuucguuggcugcaacugu

SEQ ID NO: 12520 - RNA, 19 nt, Artificial Sequence
  Synthetic Oligonucleotide
aagguagcacuggagagaa

SEQ ID NO: 12521 - RNA, 19 nt, Artificial Sequence
  Synthetic Oligonucleotide
auguugcugaaacagaucu

SEQ ID NO: 12522 - RNA, 19 nt, Artificial Sequence
  Synthetic Oligonucleotide
guuggcugcaacuguauau

SEQ ID NO: 12523 - RNA, 19 nt, Artificial Sequence
  Synthetic Oligonucleotide
uagaaagaaauggacuuuc

SEQ ID NO: 12524 - RNA, 19 nt, Artificial Sequence
  Synthetic Oligonucleotide
gugcacaauauuuucccau

SEQ ID NO: 12525 - RNA, 19 nt, Artificial Sequence
  Synthetic Oligonucleotide
agugcacaauauuuuccca

SEQ ID NO: 12526 - RNA, 19 nt, Artificial Sequence
  Synthetic Oligonucleotide
auucacaacuuugagaagg

SEQ ID NO: 12527 - RNA, 19 nt, Artificial Sequence
  Synthetic Oligonucleotide
augcuccggaauguugcug

SEQ ID NO: 12528 - RNA, 19 nt, Artificial Sequence
  Synthetic Oligonucleotide
uucaauacaaagggugucg

SEQ ID NO: 12529 - RNA, 19 nt, Artificial Sequence
  Synthetic Oligonucleotide
gcaacuguauaucuacaag

SEQ ID NO: 12530 - RNA, 19 nt, Artificial Sequence
  Synthetic Oligonucleotide
uugaauguagauuuccaau

SEQ ID NO: 12531 - RNA, 19 nt, Artificial Sequence
  Synthetic Oligonucleotide
gauguauguuacuucuuag

SEQ ID NO: 12532 - RNA, 19 nt, Artificial Sequence
  Synthetic Oligonucleotide
auguuuuaggauguauguu

SEQ ID NO: 12533 - RNA, 19 nt, Artificial Sequence
  Synthetic Oligonucleotide
augaugugcguaacagauu

SEQ ID NO: 12534 - RNA, 19 nt, Artificial Sequence
  Synthetic Oligonucleotide
uaguaaaauuggagguagc

SEQ ID NO: 12535 - RNA, 19 nt, Artificial Sequence
  Synthetic Oligonucleotide
gguguucaagauguccucg

SEQ ID NO: 12536 - RNA, 19 nt, Artificial Sequence
  Synthetic Oligonucleotide
uacuucuuagagagaaaua

SEQ ID NO: 12537 - RNA, 19 nt, Artificial Sequence
  Synthetic Oligonucleotide
gacagugcacaauauuuuc

SEQ ID NO: 12538 - RNA, 19 nt, Artificial Sequence
  Synthetic Oligonucleotide
agguguucaagauguccuc

SEQ ID NO: 12539 - RNA, 19 nt, Artificial Sequence
  Synthetic Oligonucleotide
uguuacuucuuagagagaa

SEQ ID NO: 12540 - RNA, 19 nt, Artificial Sequence
  Synthetic Oligonucleotide
auacaaagggugucguucu

SEQ ID NO: 12541 - RNA, 19 nt, Artificial Sequence
  Synthetic Oligonucleotide
caugucuuuaaaacagugg

SEQ ID NO: 12542 - RNA, 19 nt, Artificial Sequence
  Synthetic Oligonucleotide
cagagggugaccacagucu

SEQ ID NO: 12543 - RNA, 19 nt, Artificial Sequence
  Synthetic Oligonucleotide
caaggaugcuccggaaugu

SEQ ID NO: 12544 - RNA, 19 nt, Artificial Sequence
  Synthetic Oligonucleotide
gagagaaauaaagcauuuu

SEQ ID NO: 12545 - RNA, 19 nt, Artificial Sequence
  Synthetic Oligonucleotide
cuuugaauguagauuucca

SEQ ID NO: 12546 - RNA, 19 nt, Artificial Sequence
  Synthetic Oligonucleotide
uguuuacaugucuuuaaaa

SEQ ID NO: 12547 - RNA, 19 nt, Artificial Sequence
  Synthetic Oligonucleotide
auuggagguagcaaacacu

SEQ ID NO: 12548 - RNA, 19 nt, Artificial Sequence
  Synthetic Oligonucleotide
uaaagcaauagacccaucu

SEQ ID NO: 12549 - RNA, 19 nt, Artificial Sequence
  Synthetic Oligonucleotide
aacaugcuaaaucaguacu

SEQ ID NO: 12550 - RNA, 19 nt, Artificial Sequence
  Synthetic Oligonucleotide
acuucuuugaauguagauu

SEQ ID NO: 12551 - RNA, 19 nt, Artificial Sequence
  Synthetic Oligonucleotide
gccaauuguugcaaagggc

SEQ ID NO: 12552 - RNA, 19 nt, Artificial Sequence
  Synthetic Oligonucleotide
gcuaaagugcuguauccuu

SEQ ID NO: 12553 - RNA, 19 nt, Artificial Sequence
  Synthetic Oligonucleotide
uauuacuugacaaagagac

SEQ ID NO: 12554 - RNA, 19 nt, Artificial Sequence
  Synthetic Oligonucleotide
guucuuaaauuguaagcuc

SEQ ID NO: 12555 - RNA, 19 nt, Artificial Sequence
  Synthetic Oligonucleotide
gaaacagaucugucgacuu

SEQ ID NO: 12556 - RNA, 19 nt, Artificial Sequence
  Synthetic Oligonucleotide
auaauauugcagcauuuuc

SEQ ID NO: 12557 - RNA, 19 nt, Artificial Sequence
  Synthetic Oligonucleotide
ugauucacaacuuugagaa

SEQ ID NO: 12558 - RNA, 19 nt, Artificial Sequence
  Synthetic Oligonucleotide
ugcauauguggcuaaagca

SEQ ID NO: 12559 - RNA, 19 nt, Artificial Sequence
  Synthetic Oligonucleotide
agggugucguucuuuucca

SEQ ID NO: 12560 - RNA, 19 nt, Artificial Sequence
  Synthetic Oligonucleotide
accgucuggaugaugugcg

SEQ ID NO: 12561 - RNA, 19 nt, Artificial Sequence
  Synthetic Oligonucleotide
cuaggaaccuuuuagaaag

SEQ ID NO: 12562 - RNA, 19 nt, Artificial Sequence
  Synthetic Oligonucleotide
agccacuauugauguucug

SEQ ID NO: 12563 - RNA, 19 nt, Artificial Sequence
  Synthetic Oligonucleotide
ucaauacaaagggugucgu

SEQ ID NO: 12564 - RNA, 19 nt, Artificial Sequence
  Synthetic Oligonucleotide
uucuuugaauguagauuuc

SEQ ID NO: 12565 - RNA, 19 nt, Artificial Sequence
  Synthetic Oligonucleotide
uucguuggcugcaacugua

SEQ ID NO: 12566 - RNA, 19 nt, Artificial Sequence
  Synthetic Oligonucleotide
agcaauaaccugugaaaau

SEQ ID NO: 12567 - RNA, 19 nt, Artificial Sequence
  Synthetic Oligonucleotide
aagucuauauaugacuauu

SEQ ID NO: 12568 - RNA, 19 nt, Artificial Sequence
  Synthetic Oligonucleotide
ucauuuucuccugaggaaa

SEQ ID NO: 12569 - RNA, 19 nt, Artificial Sequence
  Synthetic Oligonucleotide
gcauauguggcuaaagcaa

SEQ ID NO: 12570 - RNA, 19 nt, Artificial Sequence
  Synthetic Oligonucleotide
acgacaguggacuugcugc

SEQ ID NO: 12571 - RNA, 19 nt, Artificial Sequence
  Synthetic Oligonucleotide
uuuccaagaucugacagug

SEQ ID NO: 12572 - RNA, 19 nt, Artificial Sequence
  Synthetic Oligonucleotide
aaugaugaagaaacuuugg

SEQ ID NO: 12573 - RNA, 19 nt, Artificial Sequence
  Synthetic Oligonucleotide
agagggugaccacagucug

SEQ ID NO: 12574 - RNA, 19 nt, Artificial Sequence
  Synthetic Oligonucleotide
gagaaauaaagcauuuuug

SEQ ID NO: 12575 - RNA, 19 nt, Artificial Sequence
  Synthetic Oligonucleotide
ugaaugggaucuugguguc

SEQ ID NO: 12576 - RNA, 19 nt, Artificial Sequence
  Synthetic Oligonucleotide
uguaauuccccacuucaau

SEQ ID NO: 12577 - RNA, 19 nt, Artificial Sequence
  Synthetic Oligonucleotide
gcuguauccuuuaguaaaa

SEQ ID NO: 12578 - RNA, 19 nt, Artificial Sequence
  Synthetic Oligonucleotide
agaagguagcacuggagag

SEQ ID NO: 12579 - RNA, 19 nt, Artificial Sequence
  Synthetic Oligonucleotide
cagccacuauugauguucu

SEQ ID NO: 12580 - RNA, 19 nt, Artificial Sequence
  Synthetic Oligonucleotide
ugacagugcacaauauuuu

SEQ ID NO: 12581 - RNA, 19 nt, Artificial Sequence
  Synthetic Oligonucleotide
guccuaggaaccuuuuaga

SEQ ID NO: 12582 - RNA, 19 nt, Artificial Sequence
  Synthetic Oligonucleotide
gaaugggaucuuggugucg

SEQ ID NO: 12583 - RNA, 19 nt, Artificial Sequence
  Synthetic Oligonucleotide
gagggugaccacagucugu

SEQ ID NO: 12584 - RNA, 19 nt, Artificial Sequence
  Synthetic Oligonucleotide
gaucugacagugcacaaua

SEQ ID NO: 12585 - RNA, 19 nt, Artificial Sequence
  Synthetic Oligonucleotide
uacuuccaaagucuauaua

SEQ ID NO: 12586 - RNA, 19 nt, Artificial Sequence
  Synthetic Oligonucleotide
uuagaaagaaauggacuuu

SEQ ID NO: 12587 - RNA, 19 nt, Artificial Sequence
  Synthetic Oligonucleotide
agugggugccagaauguga

SEQ ID NO: 12588 - RNA, 19 nt, Artificial Sequence
  Synthetic Oligonucleotide
ugaggaaaauuuuggagac

SEQ ID NO: 12589 - RNA, 19 nt, Artificial Sequence
  Synthetic Oligonucleotide
ggggugccagccacuauug

SEQ ID NO: 12590 - RNA, 19 nt, Artificial Sequence
  Synthetic Oligonucleotide
cccggcuaauuuguaucaa

SEQ ID NO: 12591 - RNA, 19 nt, Artificial Sequence
  Synthetic Oligonucleotide
gcagagggugaccacaguc

SEQ ID NO: 12592 - RNA, 19 nt, Artificial Sequence
  Synthetic Oligonucleotide
caaggccauauuugugaca

SEQ ID NO: 12593 - RNA, 19 nt, Artificial Sequence
  Synthetic Oligonucleotide
ucuuuaaaacagugguucu

SEQ ID NO: 12594 - RNA, 19 nt, Artificial Sequence
  Synthetic Oligonucleotide
ccucgagauacuaaaggaa

SEQ ID NO: 12595 - RNA, 19 nt, Artificial Sequence
  Synthetic Oligonucleotide
aagcaauagacccaucuau

SEQ ID NO: 12596 - RNA, 19 nt, Artificial Sequence
  Synthetic Oligonucleotide
cauuuuccagauggaagcu

SEQ ID NO: 12597 - RNA, 19 nt, Artificial Sequence
  Synthetic Oligonucleotide
augcuaaaucaguacuucc

SEQ ID NO: 12598 - RNA, 19 nt, Artificial Sequence
  Synthetic Oligonucleotide
cuuuuagaaagaaauggac

SEQ ID NO: 12599 - RNA, 19 nt, Artificial Sequence
  Synthetic Oligonucleotide
guacuuuaucauuuucucc

SEQ ID NO: 12600 - RNA, 19 nt, Artificial Sequence
  Synthetic Oligonucleotide
uaaaucaguacuuccaaag

SEQ ID NO: 12601 - RNA, 19 nt, Artificial Sequence
  Synthetic Oligonucleotide
acagaucugucgacuucug

SEQ ID NO: 12602 - RNA, 19 nt, Artificial Sequence
  Synthetic Oligonucleotide
agacauuggugaggaaaaa

SEQ ID NO: 12603 - RNA, 19 nt, Artificial Sequence
  Synthetic Oligonucleotide
uuccaacaaaauagcaauc

SEQ ID NO: 12604 - RNA, 19 nt, Artificial Sequence
  Synthetic Oligonucleotide
aacagaucugucgacuucu

SEQ ID NO: 12605 - RNA, 19 nt, Artificial Sequence
  Synthetic Oligonucleotide
aacuguauaucuacaagga

SEQ ID NO: 12606 - RNA, 19 nt, Artificial Sequence
  Synthetic Oligonucleotide
cugauucacaacuuugaga

SEQ ID NO: 12607 - RNA, 19 nt, Artificial Sequence
  Synthetic Oligonucleotide
aaacuuuggcugauaauau

SEQ ID NO: 12608 - RNA, 19 nt, Artificial Sequence
  Synthetic Oligonucleotide
uccaaucacaucuuuagug

SEQ ID NO: 12609 - RNA, 19 nt, Artificial Sequence
  Synthetic Oligonucleotide
ugcuccggaauguugcuga

SEQ ID NO: 12610 - RNA, 19 nt, Artificial Sequence
  Synthetic Oligonucleotide
guaauuccccacuucaaua

SEQ ID NO: 12611 - RNA, 19 nt, Artificial Sequence
  Synthetic Oligonucleotide
aaccuuuuagaaagaaaug

SEQ ID NO: 12612 - RNA, 19 nt, Artificial Sequence
  Synthetic Oligonucleotide
guguucaagauguccucga

SEQ ID NO: 12613 - RNA, 19 nt, Artificial Sequence
  Synthetic Oligonucleotide
aauuccccacuucaauaca

SEQ ID NO: 12614 - RNA, 19 nt, Artificial Sequence
  Synthetic Oligonucleotide
ggcugcaacuguauaucua

SEQ ID NO: 12615 - RNA, 19 nt, Artificial Sequence
  Synthetic Oligonucleotide
ugucuuuaaaacagugguu

SEQ ID NO: 12616 - RNA, 19 nt, Artificial Sequence
  Synthetic Oligonucleotide
gacagagggucagcaugcc

SEQ ID NO: 12617 - RNA, 19 nt, Artificial Sequence
  Synthetic Oligonucleotide
agauguccucgagauacua

SEQ ID NO: 12618 - RNA, 19 nt, Artificial Sequence
  Synthetic Oligonucleotide
ggcgguaauuggugauacu

SEQ ID NO: 12619 - RNA, 19 nt, Artificial Sequence
  Synthetic Oligonucleotide
uucuuagagagaaauaaag

SEQ ID NO: 12620 - RNA, 19 nt, Artificial Sequence
  Synthetic Oligonucleotide
uaaaauuggagguagcaaa

SEQ ID NO: 12621 - RNA, 19 nt, Artificial Sequence
  Synthetic Oligonucleotide
gucuuuaaaacagugguuc

SEQ ID NO: 12622 - RNA, 19 nt, Artificial Sequence
  Synthetic Oligonucleotide
aggauguauguuacuucuu

SEQ ID NO: 12623 - RNA, 19 nt, Artificial Sequence
  Synthetic Oligonucleotide
uguauccuuuaguaaaauu

SEQ ID NO: 12624 - RNA, 19 nt, Artificial Sequence
  Synthetic Oligonucleotide
agcauuuuccagauggaag

SEQ ID NO: 12625 - RNA, 19 nt, Artificial Sequence
  Synthetic Oligonucleotide
cacaacuuugagaagguag

SEQ ID NO: 12626 - RNA, 19 nt, Artificial Sequence
  Synthetic Oligonucleotide
uucuuuuccaacaaaauag

SEQ ID NO: 12627 - RNA, 19 nt, Artificial Sequence
  Synthetic Oligonucleotide
ugagugggugccagaaugu

SEQ ID NO: 12628 - RNA, 19 nt, Artificial Sequence
  Synthetic Oligonucleotide
aucaaauggcugagaagac

SEQ ID NO: 12629 - RNA, 19 nt, Artificial Sequence
  Synthetic Oligonucleotide
gccgccacaacucaggaug

SEQ ID NO: 12630 - RNA, 19 nt, Artificial Sequence
  Synthetic Oligonucleotide
aggaugcuccggaauguug

SEQ ID NO: 12631 - RNA, 19 nt, Artificial Sequence
  Synthetic Oligonucleotide
gagguagcaaacacuaagg

SEQ ID NO: 12632 - RNA, 19 nt, Artificial Sequence
  Synthetic Oligonucleotide
cacagucuguaauucccca

SEQ ID NO: 12633 - RNA, 19 nt, Artificial Sequence
  Synthetic Oligonucleotide
aauguugcugaaacagauc

SEQ ID NO: 12634 - RNA, 19 nt, Artificial Sequence
  Synthetic Oligonucleotide
cuaaaucaguacuuccaaa

SEQ ID NO: 12635 - RNA, 19 nt, Artificial Sequence
  Synthetic Oligonucleotide
caacuguauaucuacaagg

SEQ ID NO: 12636 - RNA, 19 nt, Artificial Sequence
  Synthetic Oligonucleotide
acaugcuaaaucaguacuu

SEQ ID NO: 12637 - RNA, 19 nt, Artificial Sequence
  Synthetic Oligonucleotide
gauaucaaauggcugagaa

SEQ ID NO: 12638 - RNA, 19 nt, Artificial Sequence
  Synthetic Oligonucleotide
acuucuuagagagaaauaa

SEQ ID NO: 12639 - RNA, 19 nt, Artificial Sequence
  Synthetic Oligonucleotide
ccgucuggaugaugugcgu

SEQ ID NO: 12640 - RNA, 19 nt, Artificial Sequence
  Synthetic Oligonucleotide
ugccaauuguugcaaaggg

SEQ ID NO: 12641 - RNA, 19 nt, Artificial Sequence
  Synthetic Oligonucleotide
acaaagggugucguucuuu

SEQ ID NO: 12642 - RNA, 19 nt, Artificial Sequence
  Synthetic Oligonucleotide
gucaucgacaagacauugg

SEQ ID NO: 12643 - RNA, 19 nt, Artificial Sequence
  Synthetic Oligonucleotide
cuuuggcugauaauauugc

SEQ ID NO: 12644 - RNA, 19 nt, Artificial Sequence
  Synthetic Oligonucleotide
acuugcugcauauguggcu

SEQ ID NO: 12645 - RNA, 19 nt, Artificial Sequence
  Synthetic Oligonucleotide
cuuuuccaacaaaauagca

SEQ ID NO: 12646 - RNA, 19 nt, Artificial Sequence
  Synthetic Oligonucleotide
ccacuucaauacaaagggu

SEQ ID NO: 12647 - RNA, 19 nt, Artificial Sequence
  Synthetic Oligonucleotide
auauccaaauguuuuagga

SEQ ID NO: 12648 - RNA, 19 nt, Artificial Sequence
  Synthetic Oligonucleotide
aucuaucagcugggaagau

SEQ ID NO: 12649 - RNA, 19 nt, Artificial Sequence
  Synthetic Oligonucleotide
cgacaguggacuugcugca

SEQ ID NO: 12650 - RNA, 19 nt, Artificial Sequence
  Synthetic Oligonucleotide
uguccuaggaaccuuuuag

SEQ ID NO: 12651 - RNA, 19 nt, Artificial Sequence
  Synthetic Oligonucleotide
accacagucuguaauuccc

SEQ ID NO: 12652 - RNA, 19 nt, Artificial Sequence
  Synthetic Oligonucleotide
aaccgucuggaugaugugc

SEQ ID NO: 12653 - RNA, 19 nt, Artificial Sequence
  Synthetic Oligonucleotide
gcugcaacuguauaucuac

SEQ ID NO: 12654 - RNA, 19 nt, Artificial Sequence
  Synthetic Oligonucleotide
ccaaggaugcuccggaaug

SEQ ID NO: 12655 - RNA, 19 nt, Artificial Sequence
  Synthetic Oligonucleotide
aaggaugcuccggaauguu

SEQ ID NO: 12656 - RNA, 19 nt, Artificial Sequence
  Synthetic Oligonucleotide
uguugcugaaacagaucug

SEQ ID NO: 12657 - RNA, 19 nt, Artificial Sequence
  Synthetic Oligonucleotide
aaagggcauuuugagaggu

SEQ ID NO: 12658 - RNA, 19 nt, Artificial Sequence
  Synthetic Oligonucleotide
cuaaagcaauagacccauc

SEQ ID NO: 12659 - RNA, 19 nt, Artificial Sequence
  Synthetic Oligonucleotide
ucaagauguccucgagaua

SEQ ID NO: 12660 - RNA, 19 nt, Artificial Sequence
  Synthetic Oligonucleotide
ugaccacagucuguaauuc

SEQ ID NO: 12661 - RNA, 19 nt, Artificial Sequence
  Synthetic Oligonucleotide
aaagucaucgacaagacau

SEQ ID NO: 12662 - RNA, 19 nt, Artificial Sequence
  Synthetic Oligonucleotide
gggaagauaucaaauggcu

SEQ ID NO: 12663 - RNA, 19 nt, Artificial Sequence
  Synthetic Oligonucleotide
uccugaggaaaauuuugga

SEQ ID NO: 12664 - RNA, 19 nt, Artificial Sequence
  Synthetic Oligonucleotide
ugauguucugccagaaauu

SEQ ID NO: 12665 - RNA, 19 nt, Artificial Sequence
  Synthetic Oligonucleotide
gccagccacuauugauguu

SEQ ID NO: 12666 - RNA, 19 nt, Artificial Sequence
  Synthetic Oligonucleotide
caaagggugucguucuuuu

SEQ ID NO: 12667 - RNA, 19 nt, Artificial Sequence
  Synthetic Oligonucleotide
aucgacaagacauugguga

SEQ ID NO: 12668 - RNA, 19 nt, Artificial Sequence
  Synthetic Oligonucleotide
gaaaggcacugauguucug

SEQ ID NO: 12669 - RNA, 19 nt, Artificial Sequence
  Synthetic Oligonucleotide
gggugaccacagucuguaa

SEQ ID NO: 12670 - RNA, 19 nt, Artificial Sequence
  Synthetic Oligonucleotide
ccgccacaacucaggauga

SEQ ID NO: 12671 - RNA, 19 nt, Artificial Sequence
  Synthetic Oligonucleotide
uggcgguaauuggugauac

SEQ ID NO: 12672 - RNA, 19 nt, Artificial Sequence
  Synthetic Oligonucleotide
uugcuuuugacuuuucaau

SEQ ID NO: 12673 - RNA, 19 nt, Artificial Sequence
  Synthetic Oligonucleotide
aauggguguccuaggaacc

SEQ ID NO: 12674 - RNA, 19 nt, Artificial Sequence
  Synthetic Oligonucleotide
uuggagguagcaaacacua

SEQ ID NO: 12675 - RNA, 19 nt, Artificial Sequence
  Synthetic Oligonucleotide
cugaaacagaucugucgac

SEQ ID NO: 12676 - RNA, 19 nt, Artificial Sequence
  Synthetic Oligonucleotide
acaaggccauauuugugac

SEQ ID NO: 12677 - RNA, 19 nt, Artificial Sequence
  Synthetic Oligonucleotide
uugcagcauuuuccagaug

SEQ ID NO: 12678 - RNA, 19 nt, Artificial Sequence
  Synthetic Oligonucleotide
gcuaaaucaguacuuccaa

SEQ ID NO: 12679 - RNA, 19 nt, Artificial Sequence
  Synthetic Oligonucleotide
agugguucuuaaauuguaa

SEQ ID NO: 12680 - RNA, 19 nt, Artificial Sequence
  Synthetic Oligonucleotide
auugcuuuugacuuuucaa

SEQ ID NO: 12681 - RNA, 19 nt, Artificial Sequence
  Synthetic Oligonucleotide
agagaaauaaagcauuuuu

SEQ ID NO: 12682 - RNA, 19 nt, Artificial Sequence
  Synthetic Oligonucleotide
uguagauuuccaaucacau

SEQ ID NO: 12683 - RNA, 19 nt, Artificial Sequence
  Synthetic Oligonucleotide
uccagauggaagcuguauc

SEQ ID NO: 12684 - RNA, 19 nt, Artificial Sequence
  Synthetic Oligonucleotide
aauuguugcaaagggcauu

SEQ ID NO: 12685 - RNA, 19 nt, Artificial Sequence
  Synthetic Oligonucleotide
ucuacaaggaccgagaagu

SEQ ID NO: 12686 - RNA, 19 nt, Artificial Sequence
  Synthetic Oligonucleotide
uugagaagguagcacugga

SEQ ID NO: 12687 - RNA, 19 nt, Artificial Sequence
  Synthetic Oligonucleotide
uggagguagcaaacacuaa

SEQ ID NO: 12688 - RNA, 19 nt, Artificial Sequence
  Synthetic Oligonucleotide
caaggaccgagaagucacc

SEQ ID NO: 12689 - RNA, 19 nt, Artificial Sequence
  Synthetic Oligonucleotide
gcuacaaggccauauuugu

SEQ ID NO: 12690 - RNA, 19 nt, Artificial Sequence
  Synthetic Oligonucleotide
caguacuuuaucauuuucu

SEQ ID NO: 12691 - RNA, 19 nt, Artificial Sequence
  Synthetic Oligonucleotide
agauuuccaaucacaucuu

SEQ ID NO: 12692 - RNA, 19 nt, Artificial Sequence
  Synthetic Oligonucleotide
uuaggauguauguuacuuc

SEQ ID NO: 12693 - RNA, 19 nt, Artificial Sequence
  Synthetic Oligonucleotide
cuuuaucauuuucuccuga

SEQ ID NO: 12694 - RNA, 19 nt, Artificial Sequence
  Synthetic Oligonucleotide
gucuggaugaugugcguaa

SEQ ID NO: 12695 - RNA, 19 nt, Artificial Sequence
  Synthetic Oligonucleotide
cuguauaucuacaaggacc

SEQ ID NO: 12696 - RNA, 19 nt, Artificial Sequence
  Synthetic Oligonucleotide
aaaugaugaagaaacuuug

SEQ ID NO: 12697 - RNA, 19 nt, Artificial Sequence
  Synthetic Oligonucleotide
agaucugucgacuucuguu

SEQ ID NO: 12698 - RNA, 19 nt, Artificial Sequence
  Synthetic Oligonucleotide
agguagcacuggagagaau

SEQ ID NO: 12699 - RNA, 19 nt, Artificial Sequence
  Synthetic Oligonucleotide
aaagaaauggacuuucauc

SEQ ID NO: 12700 - RNA, 19 nt, Artificial Sequence
  Synthetic Oligonucleotide
aaaggcacugauguucuga

SEQ ID NO: 12701 - RNA, 19 nt, Artificial Sequence
  Synthetic Oligonucleotide
auggcugagaagacugaca

SEQ ID NO: 12702 - RNA, 19 nt, Artificial Sequence
  Synthetic Oligonucleotide
ccagccacuauugauguuc

SEQ ID NO: 12703 - RNA, 19 nt, Artificial Sequence
  Synthetic Oligonucleotide
ugcaacuguauaucuacaa

SEQ ID NO: 12704 - RNA, 19 nt, Artificial Sequence
  Synthetic Oligonucleotide
gaaagguguucaagauguc

SEQ ID NO: 12705 - RNA, 19 nt, Artificial Sequence
  Synthetic Oligonucleotide
guuuuaggauguauguuac

SEQ ID NO: 12706 - RNA, 19 nt, Artificial Sequence
  Synthetic Oligonucleotide
ggguguccuaggaaccuuu

SEQ ID NO: 12707 - RNA, 19 nt, Artificial Sequence
  Synthetic Oligonucleotide
aaacagaucugucgacuuc

SEQ ID NO: 12708 - RNA, 19 nt, Artificial Sequence
  Synthetic Oligonucleotide
gaagauaucaaauggcuga

SEQ ID NO: 12709 - RNA, 19 nt, Artificial Sequence
  Synthetic Oligonucleotide
uauugcagcauuuuccaga

SEQ ID NO: 12710 - RNA, 19 nt, Artificial Sequence
  Synthetic Oligonucleotide
caauacaaagggugucguu

SEQ ID NO: 12711 - RNA, 19 nt, Artificial Sequence
  Synthetic Oligonucleotide
gacuuuucaaugggugucc

SEQ ID NO: 12712 - RNA, 19 nt, Artificial Sequence
  Synthetic Oligonucleotide
ugcuuuugacuuuucaaug

SEQ ID NO: 12713 - RNA, 19 nt, Artificial Sequence
  Synthetic Oligonucleotide
guugcugaaacagaucugu

SEQ ID NO: 12714 - RNA, 19 nt, Artificial Sequence
  Synthetic Oligonucleotide
ggaauguugcugaaacaga

SEQ ID NO: 12715 - RNA, 19 nt, Artificial Sequence
  Synthetic Oligonucleotide
ggcuaaagugcuguauccu

SEQ ID NO: 12716 - RNA, 19 nt, Artificial Sequence
  Synthetic Oligonucleotide
aggcuaaagugcuguaucc

SEQ ID NO: 12717 - RNA, 19 nt, Artificial Sequence
  Synthetic Oligonucleotide
ugagaagguagcacuggag

SEQ ID NO: 12718 - RNA, 19 nt, Artificial Sequence
  Synthetic Oligonucleotide
uggcuaaagcaauagaccc

SEQ ID NO: 12719 - RNA, 19 nt, Artificial Sequence
  Synthetic Oligonucleotide
caauuguugcaaagggcau

SEQ ID NO: 12720 - RNA, 19 nt, Artificial Sequence
  Synthetic Oligonucleotide
uuaguaaaauuggagguag

SEQ ID NO: 12721 - RNA, 19 nt, Artificial Sequence
  Synthetic Oligonucleotide
guauaucuacaaggaccga

SEQ ID NO: 12722 - RNA, 19 nt, Artificial Sequence
  Synthetic Oligonucleotide
auauguggcuaaagcaaua

SEQ ID NO: 12723 - RNA, 19 nt, Artificial Sequence
  Synthetic Oligonucleotide
aauuggagguagcaaacac

SEQ ID NO: 12724 - RNA, 19 nt, Artificial Sequence
  Synthetic Oligonucleotide
uauaucuacaaggaccgag

SEQ ID NO: 12725 - RNA, 19 nt, Artificial Sequence
  Synthetic Oligonucleotide
aguggacuugcugcauaug

SEQ ID NO: 12726 - RNA, 19 nt, Artificial Sequence
  Synthetic Oligonucleotide
guauccuuuaguaaaauug

SEQ ID NO: 12727 - RNA, 19 nt, Artificial Sequence
  Synthetic Oligonucleotide
uuacuugacaaagagacac

SEQ ID NO: 12728 - RNA, 19 nt, Artificial Sequence
  Synthetic Oligonucleotide
ugacuuuucaauggguguc

SEQ ID NO: 12729 - RNA, 19 nt, Artificial Sequence
  Synthetic Oligonucleotide
uuuagaaagaaauggacuu

SEQ ID NO: 12730 - RNA, 19 nt, Artificial Sequence
  Synthetic Oligonucleotide
gaugcuccggaauguugcu

SEQ ID NO: 12731 - RNA, 19 nt, Artificial Sequence
  Synthetic Oligonucleotide
agaaagaaauggacuuuca

SEQ ID NO: 12732 - RNA, 19 nt, Artificial Sequence
  Synthetic Oligonucleotide
guuuacaugucuuuaaaac

SEQ ID NO: 12733 - RNA, 19 nt, Artificial Sequence
  Synthetic Oligonucleotide
augaugaagaaacuuuggc

SEQ ID NO: 12734 - RNA, 19 nt, Artificial Sequence
  Synthetic Oligonucleotide
gacgacaguggacuugcug

SEQ ID NO: 12735 - RNA, 19 nt, Artificial Sequence
  Synthetic Oligonucleotide
cagaucugucgacuucugu

SEQ ID NO: 12736 - RNA, 19 nt, Artificial Sequence
  Synthetic Oligonucleotide
uauguggcuaaagcaauag

SEQ ID NO: 12737 - RNA, 19 nt, Artificial Sequence
  Synthetic Oligonucleotide
gcggaaaggcacugauguu

SEQ ID NO: 12738 - RNA, 19 nt, Artificial Sequence
  Synthetic Oligonucleotide
cugcauauguggcuaaagc

SEQ ID NO: 12739 - RNA, 19 nt, Artificial Sequence
  Synthetic Oligonucleotide
ggagacgacaguggacuug

SEQ ID NO: 12740 - RNA, 19 nt, Artificial Sequence
  Synthetic Oligonucleotide
ugcagagggugaccacagu

SEQ ID NO: 12741 - RNA, 19 nt, Artificial Sequence
  Synthetic Oligonucleotide
cuuuagugucugaauauau

SEQ ID NO: 12742 - RNA, 19 nt, Artificial Sequence
  Synthetic Oligonucleotide
uucaagauguccucgagau

SEQ ID NO: 12743 - RNA, 19 nt, Artificial Sequence
  Synthetic Oligonucleotide
guaaaauuggagguagcaa

SEQ ID NO: 12744 - RNA, 19 nt, Artificial Sequence
  Synthetic Oligonucleotide
uucacaacuuugagaaggu

SEQ ID NO: 12745 - RNA, 19 nt, Artificial Sequence
  Synthetic Oligonucleotide
auaucaaauggcugagaag

SEQ ID NO: 12746 - RNA, 19 nt, Artificial Sequence
  Synthetic Oligonucleotide
gagaaagguguucaagaug

SEQ ID NO: 12747 - RNA, 19 nt, Artificial Sequence
  Synthetic Oligonucleotide
uagauuuccaaucacaucu

SEQ ID NO: 12748 - RNA, 19 nt, Artificial Sequence
  Synthetic Oligonucleotide
uuugaauguagauuuccaa

SEQ ID NO: 12749 - RNA, 19 nt, Artificial Sequence
  Synthetic Oligonucleotide
auugcagcauuuuccagau

SEQ ID NO: 12750 - RNA, 19 nt, Artificial Sequence
  Synthetic Oligonucleotide
cccacuucaauacaaaggg

SEQ ID NO: 12751 - RNA, 19 nt, Artificial Sequence
  Synthetic Oligonucleotide
cuucuuugaauguagauuu

SEQ ID NO: 12752 - RNA, 19 nt, Artificial Sequence
  Synthetic Oligonucleotide
cuugcugcauauguggcua

SEQ ID NO: 12753 - RNA, 19 nt, Artificial Sequence
  Synthetic Oligonucleotide
auggguguccuaggaaccu

SEQ ID NO: 12754 - RNA, 19 nt, Artificial Sequence
  Synthetic Oligonucleotide
gcuaaagcaauagacccau

SEQ ID NO: 12755 - RNA, 19 nt, Artificial Sequence
  Synthetic Oligonucleotide
cgagauacuaaaggaagaa

SEQ ID NO: 12756 - RNA, 19 nt, Artificial Sequence
  Synthetic Oligonucleotide
gugcggaaaggcacugaug

SEQ ID NO: 12757 - RNA, 19 nt, Artificial Sequence
  Synthetic Oligonucleotide
uuuaggauguauguuacuu

SEQ ID NO: 12758 - RNA, 19 nt, Artificial Sequence
  Synthetic Oligonucleotide
aggaaaauuuuggagacga

SEQ ID NO: 12759 - RNA, 19 nt, Artificial Sequence
  Synthetic Oligonucleotide
cuuuaguaaaauuggaggu

SEQ ID NO: 12760 - RNA, 19 nt, Artificial Sequence
  Synthetic Oligonucleotide
ggacagagggucagcaugc

SEQ ID NO: 12761 - RNA, 19 nt, Artificial Sequence
  Synthetic Oligonucleotide
cugucgacuucuguuuuag

SEQ ID NO: 12762 - RNA, 19 nt, Artificial Sequence
  Synthetic Oligonucleotide
uuuuaggauguauguuacu

SEQ ID NO: 12763 - RNA, 19 nt, Artificial Sequence
  Synthetic Oligonucleotide
uagcacuggagagaauugg

SEQ ID NO: 12764 - RNA, 19 nt, Artificial Sequence
  Synthetic Oligonucleotide
aaauuggagguagcaaaca

SEQ ID NO: 12765 - RNA, 19 nt, Artificial Sequence
  Synthetic Oligonucleotide
uggcugagaagacugacau

SEQ ID NO: 12766 - RNA, 19 nt, Artificial Sequence
  Synthetic Oligonucleotide
uuccaaucacaucuuuagu

SEQ ID NO: 12767 - RNA, 19 nt, Artificial Sequence
  Synthetic Oligonucleotide
cuucaauacaaaggguguc

SEQ ID NO: 12768 - RNA, 19 nt, Artificial Sequence
  Synthetic Oligonucleotide
uguauaucuacaaggaccg

SEQ ID NO: 12769 - RNA, 19 nt, Artificial Sequence
  Synthetic Oligonucleotide
gacuugcugcauauguggc

SEQ ID NO: 12770 - RNA, 19 nt, Artificial Sequence
  Synthetic Oligonucleotide
aacuuuggcugauaauauu

SEQ ID NO: 12771 - RNA, 19 nt, Artificial Sequence
  Synthetic Oligonucleotide
aauuuuggagacgacagug

SEQ ID NO: 12772 - RNA, 19 nt, Artificial Sequence
  Synthetic Oligonucleotide
ucugucgacuucuguuuua

SEQ ID NO: 12773 - RNA, 19 nt, Artificial Sequence
  Synthetic Oligonucleotide
ucuggggcaaaugaugaag

SEQ ID NO: 12774 - RNA, 19 nt, Artificial Sequence
  Synthetic Oligonucleotide
ucuccugaggaaaauuuug

SEQ ID NO: 12775 - RNA, 19 nt, Artificial Sequence
  Synthetic Oligonucleotide
guggcuaaagcaauagacc

SEQ ID NO: 12776 - RNA, 19 nt, Artificial Sequence
  Synthetic Oligonucleotide
acagagggucagcaugcca

SEQ ID NO: 12777 - RNA, 19 nt, Artificial Sequence
  Synthetic Oligonucleotide
uuuugacuuuucaaugggu

SEQ ID NO: 12778 - RNA, 19 nt, Artificial Sequence
  Synthetic Oligonucleotide
ggaaaggcacugauguucu

SEQ ID NO: 12779 - RNA, 19 nt, Artificial Sequence
  Synthetic Oligonucleotide
ccacagucuguaauucccc

SEQ ID NO: 12780 - RNA, 19 nt, Artificial Sequence
  Synthetic Oligonucleotide
uuuggcugauaauauugca

SEQ ID NO: 12781 - RNA, 19 nt, Artificial Sequence
  Synthetic Oligonucleotide
ggaaccuuuuagaaagaaa

SEQ ID NO: 12782 - RNA, 19 nt, Artificial Sequence
  Synthetic Oligonucleotide
uccucgagauacuaaagga

SEQ ID NO: 12783 - RNA, 19 nt, Artificial Sequence
  Synthetic Oligonucleotide
gagauacuaaaggaagaau

SEQ ID NO: 12784 - RNA, 19 nt, Artificial Sequence
  Synthetic Oligonucleotide
ccaucuaucagcugggaag

SEQ ID NO: 12785 - RNA, 19 nt, Artificial Sequence
  Synthetic Oligonucleotide
gcugaaacagaucugucga

SEQ ID NO: 12786 - RNA, 19 nt, Artificial Sequence
  Synthetic Oligonucleotide
uuuaguaaaauuggaggua

SEQ ID NO: 12787 - RNA, 19 nt, Artificial Sequence
  Synthetic Oligonucleotide
gagacacugugcagagggu

SEQ ID NO: 12788 - RNA, 19 nt, Artificial Sequence
  Synthetic Oligonucleotide
uccuuuaguaaaauuggag

SEQ ID NO: 12789 - RNA, 19 nt, Artificial Sequence
  Synthetic Oligonucleotide
cagcauuuuccagauggaa

SEQ ID NO: 12790 - RNA, 19 nt, Artificial Sequence
  Synthetic Oligonucleotide
acuguauaucuacaaggac

SEQ ID NO: 12791 - RNA, 19 nt, Artificial Sequence
  Synthetic Oligonucleotide
cuuuugacuuuucaauggg

SEQ ID NO: 12792 - RNA, 19 nt, Artificial Sequence
  Synthetic Oligonucleotide
cuaaagugcuguauccuuu

SEQ ID NO: 12793 - RNA, 19 nt, Artificial Sequence
  Synthetic Oligonucleotide
uccuaggaaccuuuuagaa

SEQ ID NO: 12794 - RNA, 19 nt, Artificial Sequence
  Synthetic Oligonucleotide
aagagacacugugcagagg

SEQ ID NO: 12795 - RNA, 19 nt, Artificial Sequence
  Synthetic Oligonucleotide
uggguguccuaggaaccuu

SEQ ID NO: 12796 - RNA, 19 nt, Artificial Sequence
  Synthetic Oligonucleotide
gacccaucuaucagcuggg

SEQ ID NO: 12797 - RNA, 19 nt, Artificial Sequence
  Synthetic Oligonucleotide
uuuucuccugaggaaaauu

SEQ ID NO: 12798 - RNA, 19 nt, Artificial Sequence
  Synthetic Oligonucleotide
aaagcaauagacccaucua

SEQ ID NO: 12799 - RNA, 19 nt, Artificial Sequence
  Synthetic Oligonucleotide
uggggugccagccacuauu

SEQ ID NO: 12800 - RNA, 19 nt, Artificial Sequence
  Synthetic Oligonucleotide
ugaaacagaucugucgacu

SEQ ID NO: 12801 - RNA, 19 nt, Artificial Sequence
  Synthetic Oligonucleotide
ccccacuucaauacaaagg

SEQ ID NO: 12802 - RNA, 19 nt, Artificial Sequence
  Synthetic Oligonucleotide
uuuacaugucuuuaaaaca

SEQ ID NO: 12803 - RNA, 19 nt, Artificial Sequence
  Synthetic Oligonucleotide
gagaagguagcacuggaga

SEQ ID NO: 12804 - RNA, 19 nt, Artificial Sequence
  Synthetic Oligonucleotide
uguauccaaggaugcuccg

SEQ ID NO: 12805 - RNA, 19 nt, Artificial Sequence
  Synthetic Oligonucleotide
gcaaagggcauuuugagag

SEQ ID NO: 12806 - RNA, 19 nt, Artificial Sequence
  Synthetic Oligonucleotide
ggguggcgguaauugguga

SEQ ID NO: 12807 - RNA, 19 nt, Artificial Sequence
  Synthetic Oligonucleotide
ccaauuguugcaaagggca

SEQ ID NO: 12808 - RNA, 19 nt, Artificial Sequence
  Synthetic Oligonucleotide
auguagauuuccaaucaca

SEQ ID NO: 12809 - RNA, 19 nt, Artificial Sequence
  Synthetic Oligonucleotide
gacaaagagacacugugca

SEQ ID NO: 12810 - RNA, 19 nt, Artificial Sequence
  Synthetic Oligonucleotide
ugcugaaacagaucugucg

SEQ ID NO: 12811 - RNA, 19 nt, Artificial Sequence
  Synthetic Oligonucleotide
ccugaggaaaauuuuggag

SEQ ID NO: 12812 - RNA, 19 nt, Artificial Sequence
  Synthetic Oligonucleotide
uuagagagaaauaaagcau

SEQ ID NO: 12813 - RNA, 19 nt, Artificial Sequence
  Synthetic Oligonucleotide
ggcuaaagcaauagaccca

SEQ ID NO: 12814 - RNA, 19 nt, Artificial Sequence
  Synthetic Oligonucleotide
ccuaggaaccuuuuagaaa

SEQ ID NO: 12815 - RNA, 19 nt, Artificial Sequence
  Synthetic Oligonucleotide
caucauugccaauuguugc

SEQ ID NO: 12816 - RNA, 19 nt, Artificial Sequence
  Synthetic Oligonucleotide
cagauggaagcuguaucca

SEQ ID NO: 12817 - RNA, 19 nt, Artificial Sequence
  Synthetic Oligonucleotide
ugugcagagggugaccaca

SEQ ID NO: 12818 - RNA, 19 nt, Artificial Sequence
  Synthetic Oligonucleotide
gauggaagcuguauccaag

SEQ ID NO: 12819 - RNA, 19 nt, Artificial Sequence
  Synthetic Oligonucleotide
aucauugccaauuguugca

SEQ ID NO: 12820 - RNA, 19 nt, Artificial Sequence
  Synthetic Oligonucleotide
aagucaucgacaagacauu

SEQ ID NO: 12821 - RNA, 19 nt, Artificial Sequence
  Synthetic Oligonucleotide
uguggcuaaagcaauagac

SEQ ID NO: 12822 - RNA, 19 nt, Artificial Sequence
  Synthetic Oligonucleotide
cgucuggaugaugugcgua

SEQ ID NO: 12823 - RNA, 19 nt, Artificial Sequence
  Synthetic Oligonucleotide
gcuccggaauguugcugaa

SEQ ID NO: 12824 - RNA, 19 nt, Artificial Sequence
  Synthetic Oligonucleotide
uuuccaacaaaauagcaau

SEQ ID NO: 12825 - RNA, 19 nt, Artificial Sequence
  Synthetic Oligonucleotide
uuuuagaaagaaauggacu

SEQ ID NO: 12826 - RNA, 19 nt, Artificial Sequence
  Synthetic Oligonucleotide
cggaaaggcacugauguuc

SEQ ID NO: 12827 - RNA, 19 nt, Artificial Sequence
  Synthetic Oligonucleotide
aaagguguucaagaugucc

SEQ ID NO: 12828 - RNA, 19 nt, Artificial Sequence
  Synthetic Oligonucleotide
agaaagguguucaagaugu

SEQ ID NO: 12829 - RNA, 19 nt, Artificial Sequence
  Synthetic Oligonucleotide
uuguugcaaagggcauuuu

SEQ ID NO: 12830 - RNA, 19 nt, Artificial Sequence
  Synthetic Oligonucleotide
guucuuuuccaacaaaaua

SEQ ID NO: 12831 - RNA, 19 nt, Artificial Sequence
  Synthetic Oligonucleotide
cacuucaauacaaagggug

SEQ ID NO: 12832 - RNA, 19 nt, Artificial Sequence
  Synthetic Oligonucleotide
uuccaagaucugacagugc

SEQ ID NO: 12833 - RNA, 19 nt, Artificial Sequence
  Synthetic Oligonucleotide
acuucaauacaaagggugu

SEQ ID NO: 12834 - RNA, 19 nt, Artificial Sequence
  Synthetic Oligonucleotide
cuuugagaagguagcacug

SEQ ID NO: 12835 - RNA, 19 nt, Artificial Sequence
  Synthetic Oligonucleotide
ugccgccacaacucaggau

SEQ ID NO: 12836 - RNA, 19 nt, Artificial Sequence
  Synthetic Oligonucleotide
uugcugaaacagaucuguc

SEQ ID NO: 12837 - RNA, 19 nt, Artificial Sequence
  Synthetic Oligonucleotide
gaaccuuuuagaaagaaau

SEQ ID NO: 12838 - RNA, 19 nt, Artificial Sequence
  Synthetic Oligonucleotide
augucuuuaaaacaguggu

SEQ ID NO: 12839 - RNA, 19 nt, Artificial Sequence
  Synthetic Oligonucleotide
uugauguucugccagaaau

SEQ ID NO: 12840 - RNA, 19 nt, Artificial Sequence
  Synthetic Oligonucleotide
gggugccagccacuauuga

SEQ ID NO: 12841 - RNA, 19 nt, Artificial Sequence
  Synthetic Oligonucleotide
agacgacaguggacuugcu

SEQ ID NO: 12842 - RNA, 19 nt, Artificial Sequence
  Synthetic Oligonucleotide
guugcaaagggcauuuuga

SEQ ID NO: 12843 - RNA, 19 nt, Artificial Sequence
  Synthetic Oligonucleotide
aggaccgagaagucaccaa

SEQ ID NO: 12844 - RNA, 19 nt, Artificial Sequence
  Synthetic Oligonucleotide
uccggaauguugcugaaac

SEQ ID NO: 12845 - RNA, 19 nt, Artificial Sequence
  Synthetic Oligonucleotide
aggucuggggcaaaugaug

SEQ ID NO: 12846 - RNA, 19 nt, Artificial Sequence
  Synthetic Oligonucleotide
ugccagccacuauugaugu

SEQ ID NO: 12847 - RNA, 19 nt, Artificial Sequence
  Synthetic Oligonucleotide
ugcggaaaggcacugaugu

SEQ ID NO: 12848 - RNA, 19 nt, Artificial Sequence
  Synthetic Oligonucleotide
uugcugcauauguggcuaa

SEQ ID NO: 12849 - RNA, 19 nt, Artificial Sequence
  Synthetic Oligonucleotide
ugggaagauaucaaauggc

SEQ ID NO: 12850 - RNA, 19 nt, Artificial Sequence
  Synthetic Oligonucleotide
guguccuaggaaccuuuua

SEQ ID NO: 12851 - RNA, 19 nt, Artificial Sequence
  Synthetic Oligonucleotide
ucgagauacuaaaggaaga

SEQ ID NO: 12852 - RNA, 19 nt, Artificial Sequence
  Synthetic Oligonucleotide
gggcuacaaggccauauuu

SEQ ID NO: 12853 - RNA, 19 nt, Artificial Sequence
  Synthetic Oligonucleotide
ucacaacuuugagaaggua

SEQ ID NO: 12854 - RNA, 19 nt, Artificial Sequence
  Synthetic Oligonucleotide
cacuucguuggcugcaacu

SEQ ID NO: 12855 - RNA, 19 nt, Artificial Sequence
  Synthetic Oligonucleotide
gauguucugccagaaauug

SEQ ID NO: 12856 - RNA, 19 nt, Artificial Sequence
  Synthetic Oligonucleotide
guagauuuccaaucacauc

SEQ ID NO: 12857 - RNA, 19 nt, Artificial Sequence
  Synthetic Oligonucleotide
ggacuugcugcauaugugg

SEQ ID NO: 12858 - RNA, 19 nt, Artificial Sequence
  Synthetic Oligonucleotide
gcauuuuccagauggaagc

SEQ ID NO: 12859 - RNA, 19 nt, Artificial Sequence
  Synthetic Oligonucleotide
gacauuggugaggaaaaau

SEQ ID NO: 12860 - RNA, 19 nt, Artificial Sequence
  Synthetic Oligonucleotide
gugccagccacuauugaug

SEQ ID NO: 12861 - RNA, 19 nt, Artificial Sequence
  Synthetic Oligonucleotide
acaaggaccgagaagucac

SEQ ID NO: 12862 - RNA, 19 nt, Artificial Sequence
  Synthetic Oligonucleotide
aaggccauauuugugacag

SEQ ID NO: 12863 - RNA, 19 nt, Artificial Sequence
  Synthetic Oligonucleotide
guggcgguaauuggugaua

SEQ ID NO: 12864 - RNA, 19 nt, Artificial Sequence
  Synthetic Oligonucleotide
guauccaaggaugcuccgg

SEQ ID NO: 12865 - RNA, 19 nt, Artificial Sequence
  Synthetic Oligonucleotide
agauggaagcuguauccaa

SEQ ID NO: 12866 - RNA, 19 nt, Artificial Sequence
  Synthetic Oligonucleotide
caauggguguccuaggaac

SEQ ID NO: 12867 - RNA, 19 nt, Artificial Sequence
  Synthetic Oligonucleotide
caacuuugagaagguagca

SEQ ID NO: 12868 - RNA, 19 nt, Artificial Sequence
  Synthetic Oligonucleotide
uacaugucuuuaaaacagu

SEQ ID NO: 12869 - RNA, 19 nt, Artificial Sequence
  Synthetic Oligonucleotide
auggguggcgguaauuggu

SEQ ID NO: 12870 - RNA, 19 nt, Artificial Sequence
  Synthetic Oligonucleotide
uuucaauggguguccuagg

SEQ ID NO: 12871 - RNA, 19 nt, Artificial Sequence
  Synthetic Oligonucleotide
uugacaaagagacacugug

SEQ ID NO: 12872 - RNA, 19 nt, Artificial Sequence
  Synthetic Oligonucleotide
gaaagaaauggacuuucau

SEQ ID NO: 12873 - RNA, 19 nt, Artificial Sequence
  Synthetic Oligonucleotide
cuguauccuuuaguaaaau

SEQ ID NO: 12874 - RNA, 19 nt, Artificial Sequence
  Synthetic Oligonucleotide
uaucagcugggaagauauc

SEQ ID NO: 12875 - RNA, 19 nt, Artificial Sequence
  Synthetic Oligonucleotide
ggugccagccacuauugau

SEQ ID NO: 12876 - RNA, 19 nt, Artificial Sequence
  Synthetic Oligonucleotide
acaggucuggggcaaauga

SEQ ID NO: 12877 - RNA, 19 nt, Artificial Sequence
  Synthetic Oligonucleotide
ugggugccagaaugugaaa

SEQ ID NO: 12878 - RNA, 19 nt, Artificial Sequence
  Synthetic Oligonucleotide
auggaagcuguauccaagg

SEQ ID NO: 12879 - RNA, 19 nt, Artificial Sequence
  Synthetic Oligonucleotide
cugagugggugccagaaug

SEQ ID NO: 12880 - RNA, 19 nt, Artificial Sequence
  Synthetic Oligonucleotide
uuuuccagauggaagcugu

SEQ ID NO: 12881 - RNA, 19 nt, Artificial Sequence
  Synthetic Oligonucleotide
uaucuacaaggaccgagaa

SEQ ID NO: 12882 - RNA, 19 nt, Artificial Sequence
  Synthetic Oligonucleotide
gaggaaaauuuuggagacg

SEQ ID NO: 12883 - RNA, 19 nt, Artificial Sequence
  Synthetic Oligonucleotide
agggugaccacagucugua

SEQ ID NO: 12884 - RNA, 19 nt, Artificial Sequence
  Synthetic Oligonucleotide
ugacaaagagacacugugc

SEQ ID NO: 12885 - RNA, 19 nt, Artificial Sequence
  Synthetic Oligonucleotide
aagguguucaagauguccu

SEQ ID NO: 12886 - RNA, 19 nt, Artificial Sequence
  Synthetic Oligonucleotide
agcacuggagagaauugga

SEQ ID NO: 12887 - RNA, 19 nt, Artificial Sequence
  Synthetic Oligonucleotide
uuacaugucuuuaaaacag

SEQ ID NO: 12888 - RNA, 19 nt, Artificial Sequence
  Synthetic Oligonucleotide
cgagaagucaccaagaagc

SEQ ID NO: 12889 - RNA, 19 nt, Artificial Sequence
  Synthetic Oligonucleotide
gucuauauaugacuauuac

SEQ ID NO: 12890 - RNA, 19 nt, Artificial Sequence
  Synthetic Oligonucleotide
ucuauauaugacuauuaca

SEQ ID NO: 12891 - RNA, 19 nt, Artificial Sequence
  Synthetic Oligonucleotide
caaagggcauuuugagagg

SEQ ID NO: 12892 - RNA, 19 nt, Artificial Sequence
  Synthetic Oligonucleotide
ggaagauaucaaauggcug

SEQ ID NO: 12893 - RNA, 19 nt, Artificial Sequence
  Synthetic Oligonucleotide
cagauucaaacugccgcca

SEQ ID NO: 12894 - RNA, 19 nt, Artificial Sequence
  Synthetic Oligonucleotide
ggaugcuccggaauguugc

SEQ ID NO: 12895 - RNA, 19 nt, Artificial Sequence
  Synthetic Oligonucleotide
cugaggaaaauuuuggaga

SEQ ID NO: 12896 - RNA, 19 nt, Artificial Sequence
  Synthetic Oligonucleotide
uacaaggaccgagaaguca

SEQ ID NO: 12897 - RNA, 19 nt, Artificial Sequence
  Synthetic Oligonucleotide
caaaugaugaagaaacuuu

SEQ ID NO: 12898 - RNA, 19 nt, Artificial Sequence
  Synthetic Oligonucleotide
aaggcacugauguucugaa

SEQ ID NO: 12899 - RNA, 19 nt, Artificial Sequence
  Synthetic Oligonucleotide
gcaaaugaugaagaaacuu

SEQ ID NO: 12900 - RNA, 19 nt, Artificial Sequence
  Synthetic Oligonucleotide
uggguggcgguaauuggug

SEQ ID NO: 12901 - RNA, 19 nt, Artificial Sequence
  Synthetic Oligonucleotide
cuggggcaaaugaugaaga

SEQ ID NO: 12902 - RNA, 19 nt, Artificial Sequence
  Synthetic Oligonucleotide
aauggguggcgguaauugg

SEQ ID NO: 12903 - RNA, 19 nt, Artificial Sequence
  Synthetic Oligonucleotide
ugucgacuucuguuuuagg

SEQ ID NO: 12904 - RNA, 19 nt, Artificial Sequence
  Synthetic Oligonucleotide
cugcaacuguauaucuaca

SEQ ID NO: 12905 - RNA, 19 nt, Artificial Sequence
  Synthetic Oligonucleotide
cauauguggcuaaagcaau

SEQ ID NO: 12906 - RNA, 19 nt, Artificial Sequence
  Synthetic Oligonucleotide
acugccgccacaacucagg

SEQ ID NO: 12907 - RNA, 19 nt, Artificial Sequence
  Synthetic Oligonucleotide
cuaucagcugggaagauau

SEQ ID NO: 12908 - RNA, 19 nt, Artificial Sequence
  Synthetic Oligonucleotide
aaaauuggagguagcaaac

SEQ ID NO: 12909 - RNA, 19 nt, Artificial Sequence
  Synthetic Oligonucleotide
acauuggugaggaaaaauc

SEQ ID NO: 12910 - RNA, 19 nt, Artificial Sequence
  Synthetic Oligonucleotide
caaagagacacugugcaga

SEQ ID NO: 12911 - RNA, 19 nt, Artificial Sequence
  Synthetic Oligonucleotide
gaccacagucuguaauucc

SEQ ID NO: 12912 - RNA, 19 nt, Artificial Sequence
  Synthetic Oligonucleotide
ggagaaagguguucaagau

SEQ ID NO: 12913 - RNA, 19 nt, Artificial Sequence
  Synthetic Oligonucleotide
uuugagaagguagcacugg

SEQ ID NO: 12914 - RNA, 19 nt, Artificial Sequence
  Synthetic Oligonucleotide
aagggcauuuugagaggug

SEQ ID NO: 12915 - RNA, 19 nt, Artificial Sequence
  Synthetic Oligonucleotide
uacaggucuggggcaaaug

SEQ ID NO: 12916 - RNA, 19 nt, Artificial Sequence
  Synthetic Oligonucleotide
auuuucuccugaggaaaau

SEQ ID NO: 12917 - RNA, 19 nt, Artificial Sequence
  Synthetic Oligonucleotide
uauccuuuaguaaaauugg

SEQ ID NO: 12918 - RNA, 19 nt, Artificial Sequence
  Synthetic Oligonucleotide
ucuaucagcugggaagaua

SEQ ID NO: 12919 - RNA, 19 nt, Artificial Sequence
  Synthetic Oligonucleotide
ugggccaccuccucaauug

SEQ ID NO: 12920 - RNA, 19 nt, Artificial Sequence
  Synthetic Oligonucleotide
cuacaaggaccgagaaguc

SEQ ID NO: 12921 - RNA, 19 nt, Artificial Sequence
  Synthetic Oligonucleotide
gaauggguggcgguaauug

SEQ ID NO: 12922 - RNA, 19 nt, Artificial Sequence
  Synthetic Oligonucleotide
ggcuacaaggccauauuug

SEQ ID NO: 12923 - RNA, 19 nt, Artificial Sequence
  Synthetic Oligonucleotide
uuucuccugaggaaaauuu

SEQ ID NO: 12924 - RNA, 19 nt, Artificial Sequence
  Synthetic Oligonucleotide
ggaccgagaagucaccaag

SEQ ID NO: 12925 - RNA, 19 nt, Artificial Sequence
  Synthetic Oligonucleotide
gguguccuaggaaccuuuu

SEQ ID NO: 12926 - RNA, 19 nt, Artificial Sequence
  Synthetic Oligonucleotide
ccgagaagucaccaagaag

SEQ ID NO: 12927 - RNA, 19 nt, Artificial Sequence
  Synthetic Oligonucleotide
cucgagauacuaaaggaag

SEQ ID NO: 12928 - RNA, 19 nt, Artificial Sequence
  Synthetic Oligonucleotide
gagacgacaguggacuugc

SEQ ID NO: 12929 - RNA, 19 nt, Artificial Sequence
  Synthetic Oligonucleotide
agacccaucuaucagcugg

SEQ ID NO: 12930 - RNA, 19 nt, Artificial Sequence
  Synthetic Oligonucleotide
ucugagugggugccagaau

SEQ ID NO: 12931 - RNA, 19 nt, Artificial Sequence
  Synthetic Oligonucleotide
acaaagagacacugugcag

SEQ ID NO: 12932 - RNA, 19 nt, Artificial Sequence
  Synthetic Oligonucleotide
ugcugcauauguggcuaaa

SEQ ID NO: 12933 - RNA, 19 nt, Artificial Sequence
  Synthetic Oligonucleotide
cuucuuagagagaaauaaa

SEQ ID NO: 12934 - RNA, 19 nt, Artificial Sequence
  Synthetic Oligonucleotide
ucaauggguguccuaggaa

SEQ ID NO: 12935 - RNA, 19 nt, Artificial Sequence
  Synthetic Oligonucleotide
cccaucuaucagcugggaa

SEQ ID NO: 12936 - RNA, 19 nt, Artificial Sequence
  Synthetic Oligonucleotide
cuauauaugacuauuacag

SEQ ID NO: 12937 - RNA, 19 nt, Artificial Sequence
  Synthetic Oligonucleotide
caggucuggggcaaaugau

SEQ ID NO: 12938 - RNA, 19 nt, Artificial Sequence
  Synthetic Oligonucleotide
aauagacccaucuaucagc

SEQ ID NO: 12939 - RNA, 19 nt, Artificial Sequence
  Synthetic Oligonucleotide
uugccaauuguugcaaagg

SEQ ID NO: 12940 - RNA, 19 nt, Artificial Sequence
  Synthetic Oligonucleotide
gauguccucgagauacuaa

SEQ ID NO: 12941 - RNA, 19 nt, Artificial Sequence
  Synthetic Oligonucleotide
uguugcaaagggcauuuug

SEQ ID NO: 12942 - RNA, 19 nt, Artificial Sequence
  Synthetic Oligonucleotide
ugugcggaaaggcacugau

SEQ ID NO: 12943 - RNA, 19 nt, Artificial Sequence
  Synthetic Oligonucleotide
cuccggaauguugcugaaa

SEQ ID NO: 12944 - RNA, 19 nt, Artificial Sequence
  Synthetic Oligonucleotide
gguagcacuggagagaauu

SEQ ID NO: 12945 - RNA, 19 nt, Artificial Sequence
  Synthetic Oligonucleotide
gacaguggacuugcugcau

SEQ ID NO: 12946 - RNA, 19 nt, Artificial Sequence
  Synthetic Oligonucleotide
caguggacuugcugcauau

SEQ ID NO: 12947 - RNA, 19 nt, Artificial Sequence
  Synthetic Oligonucleotide
gaggcacuucguuggcugc

SEQ ID NO: 12948 - RNA, 19 nt, Artificial Sequence
  Synthetic Oligonucleotide
uuuccaaucacaucuuuag

SEQ ID NO: 12949 - RNA, 19 nt, Artificial Sequence
  Synthetic Oligonucleotide
auuuuggagacgacagugg

SEQ ID NO: 12950 - RNA, 19 nt, Artificial Sequence
  Synthetic Oligonucleotide
auccuuuaguaaaauugga

SEQ ID NO: 12951 - RNA, 19 nt, Artificial Sequence
  Synthetic Oligonucleotide
uugaaugggaucuuggugu

SEQ ID NO: 12952 - RNA, 19 nt, Artificial Sequence
  Synthetic Oligonucleotide
cacugauguucugaaagcu

SEQ ID NO: 12953 - RNA, 19 nt, Artificial Sequence
  Synthetic Oligonucleotide
gcuugccacugugagagcc

SEQ ID NO: 12954 - RNA, 19 nt, Artificial Sequence
  Synthetic Oligonucleotide
gaaaauuuuggagacgaca

SEQ ID NO: 12955 - RNA, 19 nt, Artificial Sequence
  Synthetic Oligonucleotide
ggugaccacagucuguaau

SEQ ID NO: 12956 - RNA, 19 nt, Artificial Sequence
  Synthetic Oligonucleotide
aggacagagggucagcaug

SEQ ID NO: 12957 - RNA, 19 nt, Artificial Sequence
  Synthetic Oligonucleotide
gguggcgguaauuggugau

SEQ ID NO: 12958 - RNA, 19 nt, Artificial Sequence
  Synthetic Oligonucleotide
ggcauuuugagaggugaug

SEQ ID NO: 12959 - RNA, 19 nt, Artificial Sequence
  Synthetic Oligonucleotide
uggaagcuguauccaagga

SEQ ID NO: 12960 - RNA, 19 nt, Artificial Sequence
  Synthetic Oligonucleotide
guagcacuggagagaauug

SEQ ID NO: 12961 - RNA, 19 nt, Artificial Sequence
  Synthetic Oligonucleotide
gaccgagaagucaccaaga

SEQ ID NO: 12962 - RNA, 19 nt, Artificial Sequence
  Synthetic Oligonucleotide
acccaucuaucagcuggga

SEQ ID NO: 12963 - RNA, 19 nt, Artificial Sequence
  Synthetic Oligonucleotide
gggaggcuguuaaacaugg

SEQ ID NO: 12964 - RNA, 19 nt, Artificial Sequence
  Synthetic Oligonucleotide
aaggaccgagaagucacca

SEQ ID NO: 12965 - RNA, 19 nt, Artificial Sequence
  Synthetic Oligonucleotide
cugggaagauaucaaaugg

SEQ ID NO: 12966 - RNA, 19 nt, Artificial Sequence
  Synthetic Oligonucleotide
aucagcugggaagauauca

SEQ ID NO: 12967 - RNA, 19 nt, Artificial Sequence
  Synthetic Oligonucleotide
uuaaacauggcuugaaugg

SEQ ID NO: 12968 - RNA, 19 nt, Artificial Sequence
  Synthetic Oligonucleotide
ggaaaauuuuggagacgac

SEQ ID NO: 12969 - RNA, 19 nt, Artificial Sequence
  Synthetic Oligonucleotide
gggagaaagguguucaaga

SEQ ID NO: 12970 - RNA, 19 nt, Artificial Sequence
  Synthetic Oligonucleotide
uugcaaagggcauuuugag

SEQ ID NO: 12971 - RNA, 19 nt, Artificial Sequence
  Synthetic Oligonucleotide
auuguugcaaagggcauuu

SEQ ID NO: 12972 - RNA, 19 nt, Artificial Sequence
  Synthetic Oligonucleotide
uuuuccaacaaaauagcaa

SEQ ID NO: 12973 - RNA, 19 nt, Artificial Sequence
  Synthetic Oligonucleotide
auuccccacuucaauacaa

SEQ ID NO: 12974 - RNA, 19 nt, Artificial Sequence
  Synthetic Oligonucleotide
gacuauuacaggucugggg

SEQ ID NO: 12975 - RNA, 19 nt, Artificial Sequence
  Synthetic Oligonucleotide
gaaauuguggaggcugugg

SEQ ID NO: 12976 - RNA, 19 nt, Artificial Sequence
  Synthetic Oligonucleotide
gugcagagggugaccacag

SEQ ID NO: 12977 - RNA, 19 nt, Artificial Sequence
  Synthetic Oligonucleotide
ucauugccaauuguugcaa

SEQ ID NO: 12978 - RNA, 19 nt, Artificial Sequence
  Synthetic Oligonucleotide
uauccaaggaugcuccgga

SEQ ID NO: 12979 - RNA, 19 nt, Artificial Sequence
  Synthetic Oligonucleotide
agauacuaaaggaagaauu

SEQ ID NO: 12980 - RNA, 19 nt, Artificial Sequence
  Synthetic Oligonucleotide
agagacacugugcagaggg

SEQ ID NO: 12981 - RNA, 19 nt, Artificial Sequence
  Synthetic Oligonucleotide
aaaauuuuggagacgacag

SEQ ID NO: 12982 - RNA, 19 nt, Artificial Sequence
  Synthetic Oligonucleotide
aucugucgacuucuguuuu

SEQ ID NO: 12983 - RNA, 19 nt, Artificial Sequence
  Synthetic Oligonucleotide
gugaccacagucuguaauu

SEQ ID NO: 12984 - RNA, 19 nt, Artificial Sequence
  Synthetic Oligonucleotide
acugugcagagggugacca

SEQ ID NO: 12985 - RNA, 19 nt, Artificial Sequence
  Synthetic Oligonucleotide
uucaauggguguccuagga

SEQ ID NO: 12986 - RNA, 19 nt, Artificial Sequence
  Synthetic Oligonucleotide
uuuucaauggguguccuag

SEQ ID NO: 12987 - RNA, 19 nt, Artificial Sequence
  Synthetic Oligonucleotide
ggugugcggaaaggcacug

SEQ ID NO: 12988 - RNA, 19 nt, Artificial Sequence
  Synthetic Oligonucleotide
auguggcuaaagcaauaga

SEQ ID NO: 12989 - RNA, 19 nt, Artificial Sequence
  Synthetic Oligonucleotide
cgacuucuguuuuaggaca

SEQ ID NO: 12990 - RNA, 19 nt, Artificial Sequence
  Synthetic Oligonucleotide
gauuuccaaucacaucuuu

SEQ ID NO: 12991 - RNA, 19 nt, Artificial Sequence
  Synthetic Oligonucleotide
auguccucgagauacuaaa

SEQ ID NO: 12992 - RNA, 19 nt, Artificial Sequence
  Synthetic Oligonucleotide
ugcaaagggcauuuugaga

SEQ ID NO: 12993 - RNA, 19 nt, Artificial Sequence
  Synthetic Oligonucleotide
gauacuaaaggaagaauuc

SEQ ID NO: 12994 - RNA, 19 nt, Artificial Sequence
  Synthetic Oligonucleotide
gcuugaaugggaucuuggu

SEQ ID NO: 12995 - RNA, 19 nt, Artificial Sequence
  Synthetic Oligonucleotide
cuguuuuaggacagagggu

SEQ ID NO: 12996 - RNA, 19 nt, Artificial Sequence
  Synthetic Oligonucleotide
ugggaacgggcaugauguu

SEQ ID NO: 12997 - RNA, 19 nt, Artificial Sequence
  Synthetic Oligonucleotide
aucuacaaggaccgagaag

SEQ ID NO: 12998 - RNA, 19 nt, Artificial Sequence
  Synthetic Oligonucleotide
cuccugaggaaaauuuugg

SEQ ID NO: 12999 - RNA, 19 nt, Artificial Sequence
  Synthetic Oligonucleotide
ggcuguuaaacauggcuug

SEQ ID NO: 13000 - RNA, 19 nt, Artificial Sequence
  Synthetic Oligonucleotide
gauggggugccagccacua

SEQ ID NO: 13001 - RNA, 19 nt, Artificial Sequence
  Synthetic Oligonucleotide
gaugggcuacaaggccaua

SEQ ID NO: 13002 - RNA, 19 nt, Artificial Sequence
  Synthetic Oligonucleotide
gcuguuaaacauggcuuga

SEQ ID NO: 13003 - RNA, 19 nt, Artificial Sequence
  Synthetic Oligonucleotide
gggcauuuugagaggugau

SEQ ID NO: 13004 - RNA, 19 nt, Artificial Sequence
  Synthetic Oligonucleotide
aaauuuuggagacgacagu

SEQ ID NO: 13005 - RNA, 19 nt, Artificial Sequence
  Synthetic Oligonucleotide
gugggugccagaaugugaa

SEQ ID NO: 13006 - RNA, 19 nt, Artificial Sequence
  Synthetic Oligonucleotide
caaccgucuggaugaugug

SEQ ID NO: 13007 - RNA, 19 nt, Artificial Sequence
  Synthetic Oligonucleotide
agcaauagacccaucuauc

SEQ ID NO: 13008 - RNA, 19 nt, Artificial Sequence
  Synthetic Oligonucleotide
guggacuugcugcauaugu

SEQ ID NO: 13009 - RNA, 19 nt, Artificial Sequence
  Synthetic Oligonucleotide
cauugccaauuguugcaaa

SEQ ID NO: 13010 - RNA, 19 nt, Artificial Sequence
  Synthetic Oligonucleotide
acuauuacaggucuggggc

SEQ ID NO: 13011 - RNA, 19 nt, Artificial Sequence
  Synthetic Oligonucleotide
uccaaggaugcuccggaau

SEQ ID NO: 13012 - RNA, 19 nt, Artificial Sequence
  Synthetic Oligonucleotide
gccagaaauuguggaggcu

SEQ ID NO: 13013 - RNA, 19 nt, Artificial Sequence
  Synthetic Oligonucleotide
cuacaaggccauauuugug

SEQ ID NO: 13014 - RNA, 19 nt, Artificial Sequence
  Synthetic Oligonucleotide
ggaauggguggcgguaauu

SEQ ID NO: 13015 - RNA, 19 nt, Artificial Sequence
  Synthetic Oligonucleotide
ucgauggggugccagccac

SEQ ID NO: 13016 - RNA, 19 nt, Artificial Sequence
  Synthetic Oligonucleotide
uaaacauggcuugaauggg

SEQ ID NO: 13017 - RNA, 19 nt, Artificial Sequence
  Synthetic Oligonucleotide
uccccacuucaauacaaag

SEQ ID NO: 13018 - RNA, 19 nt, Artificial Sequence
  Synthetic Oligonucleotide
cuguuuacaugucuuuaaa

SEQ ID NO: 13019 - RNA, 19 nt, Artificial Sequence
  Synthetic Oligonucleotide
acugauguucugaaagcuc

SEQ ID NO: 13020 - RNA, 19 nt, Artificial Sequence
  Synthetic Oligonucleotide
cucugagugggugccagaa

SEQ ID NO: 13021 - RNA, 19 nt, Artificial Sequence
  Synthetic Oligonucleotide
cuugacaaagagacacugu

SEQ ID NO: 13022 - RNA, 19 nt, Artificial Sequence
  Synthetic Oligonucleotide
gucgacuucuguuuuagga

SEQ ID NO: 13023 - RNA, 19 nt, Artificial Sequence
  Synthetic Oligonucleotide
uggagacgacaguggacuu

SEQ ID NO: 13024 - RNA, 19 nt, Artificial Sequence
  Synthetic Oligonucleotide
agggcauuuugagagguga

SEQ ID NO: 13025 - RNA, 19 nt, Artificial Sequence
  Synthetic Oligonucleotide
acaacuuugagaagguagc

SEQ ID NO: 13026 - RNA, 19 nt, Artificial Sequence
  Synthetic Oligonucleotide
ugggcuacaaggccauauu

SEQ ID NO: 13027 - RNA, 19 nt, Artificial Sequence
  Synthetic Oligonucleotide
gggccaccuccucaauuga

SEQ ID NO: 13028 - RNA, 19 nt, Artificial Sequence
  Synthetic Oligonucleotide
cguuuccaagaucugacag

SEQ ID NO: 13029 - RNA, 19 nt, Artificial Sequence
  Synthetic Oligonucleotide
gggcaaaugaugaagaaac

SEQ ID NO: 13030 - RNA, 19 nt, Artificial Sequence
  Synthetic Oligonucleotide
aaugggaucuuggugucga

SEQ ID NO: 13031 - RNA, 19 nt, Artificial Sequence
  Synthetic Oligonucleotide
gcguaacagauucaaacug

SEQ ID NO: 13032 - RNA, 19 nt, Artificial Sequence
  Synthetic Oligonucleotide
augggcuacaaggccauau

SEQ ID NO: 13033 - RNA, 19 nt, Artificial Sequence
  Synthetic Oligonucleotide
gggaacgggcaugauguug

SEQ ID NO: 13034 - RNA, 19 nt, Artificial Sequence
  Synthetic Oligonucleotide
ucuguuuuaggacagaggg

SEQ ID NO: 13035 - RNA, 19 nt, Artificial Sequence
  Synthetic Oligonucleotide
aacugccgccacaacucag

SEQ ID NO: 13036 - RNA, 19 nt, Artificial Sequence
  Synthetic Oligonucleotide
agaagaugggcuacaaggc

SEQ ID NO: 13037 - RNA, 19 nt, Artificial Sequence
  Synthetic Oligonucleotide
aacagauucaaacugccgc

SEQ ID NO: 13038 - RNA, 19 nt, Artificial Sequence
  Synthetic Oligonucleotide
auccaaggaugcuccggaa

SEQ ID NO: 13039 - RNA, 19 nt, Artificial Sequence
  Synthetic Oligonucleotide
uuccagauggaagcuguau

SEQ ID NO: 13040 - RNA, 19 nt, Artificial Sequence
  Synthetic Oligonucleotide
aagcuguauccaaggaugc

SEQ ID NO: 13041 - RNA, 19 nt, Artificial Sequence
  Synthetic Oligonucleotide
cgauggggugccagccacu

SEQ ID NO: 13042 - RNA, 19 nt, Artificial Sequence
  Synthetic Oligonucleotide
uuuggagacgacaguggac

SEQ ID NO: 13043 - RNA, 19 nt, Artificial Sequence
  Synthetic Oligonucleotide
guuaaacauggcuugaaug

SEQ ID NO: 13044 - RNA, 19 nt, Artificial Sequence
  Synthetic Oligonucleotide
ggcacuucguuggcugcaa

SEQ ID NO: 13045 - RNA, 19 nt, Artificial Sequence
  Synthetic Oligonucleotide
uggcuugaaugggaucuug

SEQ ID NO: 13046 - RNA, 19 nt, Artificial Sequence
  Synthetic Oligonucleotide
cagcugggaagauaucaaa

SEQ ID NO: 13047 - RNA, 19 nt, Artificial Sequence
  Synthetic Oligonucleotide
uuuccagauggaagcugua

SEQ ID NO: 13048 - RNA, 19 nt, Artificial Sequence
  Synthetic Oligonucleotide
gcaauagacccaucuauca

SEQ ID NO: 13049 - RNA, 19 nt, Artificial Sequence
  Synthetic Oligonucleotide
guuuccaagaucugacagu

SEQ ID NO: 13050 - RNA, 19 nt, Artificial Sequence
  Synthetic Oligonucleotide
aacuuugagaagguagcac

SEQ ID NO: 13051 - RNA, 19 nt, Artificial Sequence
  Synthetic Oligonucleotide
ugccacugugagagccugu

SEQ ID NO: 13052 - RNA, 19 nt, Artificial Sequence
  Synthetic Oligonucleotide
acauggcuugaaugggauc

SEQ ID NO: 13053 - RNA, 19 nt, Artificial Sequence
  Synthetic Oligonucleotide
gcugggaagauaucaaaug

SEQ ID NO: 13054 - RNA, 19 nt, Artificial Sequence
  Synthetic Oligonucleotide
cuugaaugggaucuuggug

SEQ ID NO: 13055 - RNA, 19 nt, Artificial Sequence
  Synthetic Oligonucleotide
caauagacccaucuaucag

SEQ ID NO: 13056 - RNA, 19 nt, Artificial Sequence
  Synthetic Oligonucleotide
uuugacuuuucaaugggug

SEQ ID NO: 13057 - RNA, 19 nt, Artificial Sequence
  Synthetic Oligonucleotide
acuaaaggaagaauuccgg

SEQ ID NO: 13058 - RNA, 19 nt, Artificial Sequence
  Synthetic Oligonucleotide
cugccgccacaacucagga

SEQ ID NO: 13059 - RNA, 19 nt, Artificial Sequence
  Synthetic Oligonucleotide
augugcguaacagauucaa

SEQ ID NO: 13060 - RNA, 19 nt, Artificial Sequence
  Synthetic Oligonucleotide
ggcaaaugaugaagaaacu

SEQ ID NO: 13061 - RNA, 19 nt, Artificial Sequence
  Synthetic Oligonucleotide
gaacgggcaugauguugag

SEQ ID NO: 13062 - RNA, 19 nt, Artificial Sequence
  Synthetic Oligonucleotide
ggcuugaaugggaucuugg

SEQ ID NO: 13063 - RNA, 19 nt, Artificial Sequence
  Synthetic Oligonucleotide
cauuggugaggaaaaaucc

SEQ ID NO: 13064 - RNA, 19 nt, Artificial Sequence
  Synthetic Oligonucleotide
ucgaaucauggggcucgac

SEQ ID NO: 13065 - RNA, 19 nt, Artificial Sequence
  Synthetic Oligonucleotide
aagaugggcuacaaggcca

SEQ ID NO: 13066 - RNA, 19 nt, Artificial Sequence
  Synthetic Oligonucleotide
ugugcguaacagauucaaa

SEQ ID NO: 13067 - RNA, 19 nt, Artificial Sequence
  Synthetic Oligonucleotide
acuuugagaagguagcacu

SEQ ID NO: 13068 - RNA, 19 nt, Artificial Sequence
  Synthetic Oligonucleotide
uauuacaggucuggggcaa

SEQ ID NO: 13069 - RNA, 19 nt, Artificial Sequence
  Synthetic Oligonucleotide
uugacuuuucaaugggugu

SEQ ID NO: 13070 - RNA, 19 nt, Artificial Sequence
  Synthetic Oligonucleotide
acacugugcagagggugac

SEQ ID NO: 13071 - RNA, 19 nt, Artificial Sequence
  Synthetic Oligonucleotide
agaaauuguggaggcugug

SEQ ID NO: 13072 - RNA, 19 nt, Artificial Sequence
  Synthetic Oligonucleotide
auugccaauuguugcaaag

SEQ ID NO: 13073 - RNA, 19 nt, Artificial Sequence
  Synthetic Oligonucleotide
gcuguggaagggaaggugg

SEQ ID NO: 13074 - RNA, 19 nt, Artificial Sequence
  Synthetic Oligonucleotide
agcuugccacugugagagc

SEQ ID NO: 13075 - RNA, 19 nt, Artificial Sequence
  Synthetic Oligonucleotide
uguuuuaggacagaggguc

SEQ ID NO: 13076 - RNA, 19 nt, Artificial Sequence
  Synthetic Oligonucleotide
ggaagggaagguggaaguc

SEQ ID NO: 13077 - RNA, 19 nt, Artificial Sequence
  Synthetic Oligonucleotide
ggggcaaaugaugaagaaa

SEQ ID NO: 13078 - RNA, 19 nt, Artificial Sequence
  Synthetic Oligonucleotide
aaacugccgccacaacuca

SEQ ID NO: 13079 - RNA, 19 nt, Artificial Sequence
  Synthetic Oligonucleotide
gaagcuguauccaaggaug

SEQ ID NO: 13080 - RNA, 19 nt, Artificial Sequence
  Synthetic Oligonucleotide
uuuaggacagagggucagc

SEQ ID NO: 13081 - RNA, 19 nt, Artificial Sequence
  Synthetic Oligonucleotide
uggacuugcugcauaugug

SEQ ID NO: 13082 - RNA, 19 nt, Artificial Sequence
  Synthetic Oligonucleotide
gcucugagugggugccaga

SEQ ID NO: 13083 - RNA, 19 nt, Artificial Sequence
  Synthetic Oligonucleotide
uauauaugacuauuacagg

SEQ ID NO: 13084 - RNA, 19 nt, Artificial Sequence
  Synthetic Oligonucleotide
guaacagauucaaacugcc

SEQ ID NO: 13085 - RNA, 19 nt, Artificial Sequence
  Synthetic Oligonucleotide
auuuccaaucacaucuuua

SEQ ID NO: 13086 - RNA, 19 nt, Artificial Sequence
  Synthetic Oligonucleotide
aaagagacacugugcagag

SEQ ID NO: 13087 - RNA, 19 nt, Artificial Sequence
  Synthetic Oligonucleotide
uguggaagggaagguggaa

SEQ ID NO: 13088 - RNA, 19 nt, Artificial Sequence
  Synthetic Oligonucleotide
accgagaagucaccaagaa

SEQ ID NO: 13089 - RNA, 19 nt, Artificial Sequence
  Synthetic Oligonucleotide
gggcaaccgucuggaugau

SEQ ID NO: 13090 - RNA, 19 nt, Artificial Sequence
  Synthetic Oligonucleotide
ggcaggcuaaagugcugua

SEQ ID NO: 13091 - RNA, 19 nt, Artificial Sequence
  Synthetic Oligonucleotide
ggaggcuguuaaacauggc

SEQ ID NO: 13092 - RNA, 19 nt, Artificial Sequence
  Synthetic Oligonucleotide
gagaauuggaauggguggc

SEQ ID NO: 13093 - RNA, 19 nt, Artificial Sequence
  Synthetic Oligonucleotide
acuuuucaauggguguccu

SEQ ID NO: 13094 - RNA, 19 nt, Artificial Sequence
  Synthetic Oligonucleotide
ugaugccagggaggcuguu

SEQ ID NO: 13095 - RNA, 19 nt, Artificial Sequence
  Synthetic Oligonucleotide
agauucaaacugccgccac

SEQ ID NO: 13096 - RNA, 19 nt, Artificial Sequence
  Synthetic Oligonucleotide
uaggacagagggucagcau

SEQ ID NO: 13097 - RNA, 19 nt, Artificial Sequence
  Synthetic Oligonucleotide
agacacugugcagagggug

SEQ ID NO: 13098 - RNA, 19 nt, Artificial Sequence
  Synthetic Oligonucleotide
uggugucgaaucauggggc

SEQ ID NO: 13099 - RNA, 19 nt, Artificial Sequence
  Synthetic Oligonucleotide
auagacccaucuaucagcu

SEQ ID NO: 13100 - RNA, 19 nt, Artificial Sequence
  Synthetic Oligonucleotide
cauggcuugaaugggaucu

SEQ ID NO: 13101 - RNA, 19 nt, Artificial Sequence
  Synthetic Oligonucleotide
ucaaacugccgccacaacu

SEQ ID NO: 13102 - RNA, 19 nt, Artificial Sequence
  Synthetic Oligonucleotide
gaugaugccagggaggcug

SEQ ID NO: 13103 - RNA, 19 nt, Artificial Sequence
  Synthetic Oligonucleotide
ccugggccaccuccucaau

SEQ ID NO: 13104 - RNA, 19 nt, Artificial Sequence
  Synthetic Oligonucleotide
gauguucugaaagcucugg

SEQ ID NO: 13105 - RNA, 19 nt, Artificial Sequence
  Synthetic Oligonucleotide
cuauuacaggucuggggca

SEQ ID NO: 13106 - RNA, 19 nt, Artificial Sequence
  Synthetic Oligonucleotide
auggggugccagccacuau

SEQ ID NO: 13107 - RNA, 19 nt, Artificial Sequence
  Synthetic Oligonucleotide
ucgacuucuguuuuaggac

SEQ ID NO: 13108 - RNA, 19 nt, Artificial Sequence
  Synthetic Oligonucleotide
gacacugugcagaggguga

SEQ ID NO: 13109 - RNA, 19 nt, Artificial Sequence
  Synthetic Oligonucleotide
uuaggacagagggucagca

SEQ ID NO: 13110 - RNA, 19 nt, Artificial Sequence
  Synthetic Oligonucleotide
uggaagggaagguggaagu

SEQ ID NO: 13111 - RNA, 19 nt, Artificial Sequence
  Synthetic Oligonucleotide
aggcacugauguucugaaa

SEQ ID NO: 13112 - RNA, 19 nt, Artificial Sequence
  Synthetic Oligonucleotide
uuacaggucuggggcaaau

SEQ ID NO: 13113 - RNA, 19 nt, Artificial Sequence
  Synthetic Oligonucleotide
agaauuggaauggguggcg

SEQ ID NO: 13114 - RNA, 19 nt, Artificial Sequence
  Synthetic Oligonucleotide
auaucuacaaggaccgaga

SEQ ID NO: 13115 - RNA, 19 nt, Artificial Sequence
  Synthetic Oligonucleotide
acagauucaaacugccgcc

SEQ ID NO: 13116 - RNA, 19 nt, Artificial Sequence
  Synthetic Oligonucleotide
ggucuggggcaaaugauga

SEQ ID NO: 13117 - RNA, 19 nt, Artificial Sequence
  Synthetic Oligonucleotide
ggcaaccgucuggaugaug

SEQ ID NO: 13118 - RNA, 19 nt, Artificial Sequence
  Synthetic Oligonucleotide
auuacaggucuggggcaaa

SEQ ID NO: 13119 - RNA, 19 nt, Artificial Sequence
  Synthetic Oligonucleotide
uggggcaaaugaugaagaa

SEQ ID NO: 13120 - RNA, 19 nt, Artificial Sequence
  Synthetic Oligonucleotide
gaagaugggcuacaaggcc

SEQ ID NO: 13121 - RNA, 19 nt, Artificial Sequence
  Synthetic Oligonucleotide
uuggagacgacaguggacu

SEQ ID NO: 13122 - RNA, 19 nt, Artificial Sequence
  Synthetic Oligonucleotide
auuuugagaggugaugaug

SEQ ID NO: 13123 - RNA, 19 nt, Artificial Sequence
  Synthetic Oligonucleotide
gagaagucaccaagaagcu

SEQ ID NO: 13124 - RNA, 19 nt, Artificial Sequence
  Synthetic Oligonucleotide
ggaacgggcaugauguuga

SEQ ID NO: 13125 - RNA, 19 nt, Artificial Sequence
  Synthetic Oligonucleotide
aauuggaauggguggcggu

SEQ ID NO: 13126 - RNA, 19 nt, Artificial Sequence
  Synthetic Oligonucleotide
uguucugccagaaauugug

SEQ ID NO: 13127 - RNA, 19 nt, Artificial Sequence
  Synthetic Oligonucleotide
ggcuguggaagggaaggug

SEQ ID NO: 13128 - RNA, 19 nt, Artificial Sequence
  Synthetic Oligonucleotide
agaccaaucguuuggggcu

SEQ ID NO: 13129 - RNA, 19 nt, Artificial Sequence
  Synthetic Oligonucleotide
caaacugccgccacaacuc

SEQ ID NO: 13130 - RNA, 19 nt, Artificial Sequence
  Synthetic Oligonucleotide
gucuggggcaaaugaugaa

SEQ ID NO: 13131 - RNA, 19 nt, Artificial Sequence
  Synthetic Oligonucleotide
ucaauugaagaaguggcgg

SEQ ID NO: 13132 - RNA, 19 nt, Artificial Sequence
  Synthetic Oligonucleotide
caggcuaaagugcuguauc

SEQ ID NO: 13133 - RNA, 19 nt, Artificial Sequence
  Synthetic Oligonucleotide
agcugggaagauaucaaau

SEQ ID NO: 13134 - RNA, 19 nt, Artificial Sequence
  Synthetic Oligonucleotide
agcuguauccaaggaugcu

SEQ ID NO: 13135 - RNA, 19 nt, Artificial Sequence
  Synthetic Oligonucleotide
gagcuugccacugugagag

SEQ ID NO: 13136 - RNA, 19 nt, Artificial Sequence
  Synthetic Oligonucleotide
ccugggaacgggcaugaug

SEQ ID NO: 13137 - RNA, 19 nt, Artificial Sequence
  Synthetic Oligonucleotide
uggaauggguggcgguaau

SEQ ID NO: 13138 - RNA, 19 nt, Artificial Sequence
  Synthetic Oligonucleotide
ggugaugaugccagggagg

SEQ ID NO: 13139 - RNA, 19 nt, Artificial Sequence
  Synthetic Oligonucleotide
uguuuagacaacgucaucc

SEQ ID NO: 13140 - RNA, 19 nt, Artificial Sequence
  Synthetic Oligonucleotide
uuuuggagacgacagugga

SEQ ID NO: 13141 - RNA, 19 nt, Artificial Sequence
  Synthetic Oligonucleotide
gcauuuugagaggugauga

SEQ ID NO: 13142 - RNA, 19 nt, Artificial Sequence
  Synthetic Oligonucleotide
agaugggcuacaaggccau

SEQ ID NO: 13143 - RNA, 19 nt, Artificial Sequence
  Synthetic Oligonucleotide
auacuaaaggaagaauucc

SEQ ID NO: 13144 - RNA, 19 nt, Artificial Sequence
  Synthetic Oligonucleotide
uuuugagaggugaugaugc

SEQ ID NO: 13145 - RNA, 19 nt, Artificial Sequence
  Synthetic Oligonucleotide
ggcacugauguucugaaag

SEQ ID NO: 13146 - RNA, 19 nt, Artificial Sequence
  Synthetic Oligonucleotide
agggaggcuguuaaacaug

SEQ ID NO: 13147 - RNA, 19 nt, Artificial Sequence
  Synthetic Oligonucleotide
uucuguuuuaggacagagg

SEQ ID NO: 13148 - RNA, 19 nt, Artificial Sequence
  Synthetic Oligonucleotide
uaacagauucaaacugccg

SEQ ID NO: 13149 - RNA, 19 nt, Artificial Sequence
  Synthetic Oligonucleotide
ugccagaaauuguggaggc

SEQ ID NO: 13150 - RNA, 19 nt, Artificial Sequence
  Synthetic Oligonucleotide
gcaaccgucuggaugaugu

SEQ ID NO: 13151 - RNA, 19 nt, Artificial Sequence
  Synthetic Oligonucleotide
gagaagaugggcuacaagg

SEQ ID NO: 13152 - RNA, 19 nt, Artificial Sequence
  Synthetic Oligonucleotide
uagacccaucuaucagcug

SEQ ID NO: 13153 - RNA, 19 nt, Artificial Sequence
  Synthetic Oligonucleotide
ggcucugagugggugccag

SEQ ID NO: 13154 - RNA, 19 nt, Artificial Sequence
  Synthetic Oligonucleotide
ccguuuccaagaucugaca

SEQ ID NO: 13155 - RNA, 19 nt, Artificial Sequence
  Synthetic Oligonucleotide
gggugugcggaaaggcacu

SEQ ID NO: 13156 - RNA, 19 nt, Artificial Sequence
  Synthetic Oligonucleotide
caauugaagaaguggcgga

SEQ ID NO: 13157 - RNA, 19 nt, Artificial Sequence
  Synthetic Oligonucleotide
cugggccaccuccucaauu

SEQ ID NO: 13158 - RNA, 19 nt, Artificial Sequence
  Synthetic Oligonucleotide
ccuccucaauugaagaagu

SEQ ID NO: 13159 - RNA, 19 nt, Artificial Sequence
  Synthetic Oligonucleotide
uguuaaacauggcuugaau

SEQ ID NO: 13160 - RNA, 19 nt, Artificial Sequence
  Synthetic Oligonucleotide
ggccguuuccaagaucuga

SEQ ID NO: 13161 - RNA, 19 nt, Artificial Sequence
  Synthetic Oligonucleotide
ccucaauugaagaaguggc

SEQ ID NO: 13162 - RNA, 19 nt, Artificial Sequence
  Synthetic Oligonucleotide
auauaugacuauuacaggu

SEQ ID NO: 13163 - RNA, 19 nt, Artificial Sequence
  Synthetic Oligonucleotide
gcacuucguuggcugcaac

SEQ ID NO: 13164 - RNA, 19 nt, Artificial Sequence
  Synthetic Oligonucleotide
uccugggccaccuccucaa

SEQ ID NO: 13165 - RNA, 19 nt, Artificial Sequence
  Synthetic Oligonucleotide
gcuguauccaaggaugcuc

SEQ ID NO: 13166 - RNA, 19 nt, Artificial Sequence
  Synthetic Oligonucleotide
aaacauggcuugaauggga

SEQ ID NO: 13167 - RNA, 19 nt, Artificial Sequence
  Synthetic Oligonucleotide
cacugugcagagggugacc

SEQ ID NO: 13168 - RNA, 19 nt, Artificial Sequence
  Synthetic Oligonucleotide
aggaaaaauccuuuggccg

SEQ ID NO: 13169 - RNA, 19 nt, Artificial Sequence
  Synthetic Oligonucleotide
agagaauuggaaugggugg

SEQ ID NO: 13170 - RNA, 19 nt, Artificial Sequence
  Synthetic Oligonucleotide
gaagaaguggcggaagcug

SEQ ID NO: 13171 - RNA, 19 nt, Artificial Sequence
  Synthetic Oligonucleotide
uuccccacuucaauacaaa

SEQ ID NO: 13172 - RNA, 19 nt, Artificial Sequence
  Synthetic Oligonucleotide
uacuaaaggaagaauuccg

SEQ ID NO: 13173 - RNA, 19 nt, Artificial Sequence
  Synthetic Oligonucleotide
guggaagggaagguggaag

SEQ ID NO: 13174 - RNA, 19 nt, Artificial Sequence
  Synthetic Oligonucleotide
augacuauuacaggucugg

SEQ ID NO: 13175 - RNA, 19 nt, Artificial Sequence
  Synthetic Oligonucleotide
gccacugugagagccuguc

SEQ ID NO: 13176 - RNA, 19 nt, Artificial Sequence
  Synthetic Oligonucleotide
uuggaauggguggcgguaa

SEQ ID NO: 13177 - RNA, 19 nt, Artificial Sequence
  Synthetic Oligonucleotide
cucaauugaagaaguggcg

SEQ ID NO: 13178 - RNA, 19 nt, Artificial Sequence
  Synthetic Oligonucleotide
aacucgauggggugccagc

SEQ ID NO: 13179 - RNA, 19 nt, Artificial Sequence
  Synthetic Oligonucleotide
accuccucaauugaagaag

SEQ ID NO: 13180 - RNA, 19 nt, Artificial Sequence
  Synthetic Oligonucleotide
gaauuggaauggguggcgg

SEQ ID NO: 13181 - RNA, 19 nt, Artificial Sequence
  Synthetic Oligonucleotide
ggaaaaauccuuuggccgu

SEQ ID NO: 13182 - RNA, 19 nt, Artificial Sequence
  Synthetic Oligonucleotide
gaagggaagguggaagucu

SEQ ID NO: 13183 - RNA, 19 nt, Artificial Sequence
  Synthetic Oligonucleotide
ucagcugggaagauaucaa

SEQ ID NO: 13184 - RNA, 19 nt, Artificial Sequence
  Synthetic Oligonucleotide
uccucaauugaagaagugg

SEQ ID NO: 13185 - RNA, 19 nt, Artificial Sequence
  Synthetic Oligonucleotide
gacuucuguuuuaggacag

SEQ ID NO: 13186 - RNA, 19 nt, Artificial Sequence
  Synthetic Oligonucleotide
gcacuggagagaauuggaa

SEQ ID NO: 13187 - RNA, 19 nt, Artificial Sequence
  Synthetic Oligonucleotide
ccaaucguuuggggcuuag

SEQ ID NO: 13188 - RNA, 19 nt, Artificial Sequence
  Synthetic Oligonucleotide
ggccaccuccucaauugaa

SEQ ID NO: 13189 - RNA, 19 nt, Artificial Sequence
  Synthetic Oligonucleotide
cuguuaaacauggcuugaa

SEQ ID NO: 13190 - RNA, 19 nt, Artificial Sequence
  Synthetic Oligonucleotide
cugauguucugaaagcucu

SEQ ID NO: 13191 - RNA, 19 nt, Artificial Sequence
  Synthetic Oligonucleotide
ugcguaacagauucaaacu

SEQ ID NO: 13192 - RNA, 19 nt, Artificial Sequence
  Synthetic Oligonucleotide
auucaaacugccgccacaa

SEQ ID NO: 13193 - RNA, 19 nt, Artificial Sequence
  Synthetic Oligonucleotide
auuggaauggguggcggua

SEQ ID NO: 13194 - RNA, 19 nt, Artificial Sequence
  Synthetic Oligonucleotide
gaggaaaaauccuuuggcc

SEQ ID NO: 13195 - RNA, 19 nt, Artificial Sequence
  Synthetic Oligonucleotide
uggcaggcuaaagugcugu

SEQ ID NO: 13196 - RNA, 19 nt, Artificial Sequence
  Synthetic Oligonucleotide
augaugccagggaggcugu

SEQ ID NO: 13197 - RNA, 19 nt, Artificial Sequence
  Synthetic Oligonucleotide
uugccacugugagagccug

SEQ ID NO: 13198 - RNA, 19 nt, Artificial Sequence
  Synthetic Oligonucleotide
cauuuugagaggugaugau

SEQ ID NO: 13199 - RNA, 19 nt, Artificial Sequence
  Synthetic Oligonucleotide
guuccugggccaccuccuc

SEQ ID NO: 13200 - RNA, 19 nt, Artificial Sequence
  Synthetic Oligonucleotide
uauaugacuauuacagguc

SEQ ID NO: 13201 - RNA, 19 nt, Artificial Sequence
  Synthetic Oligonucleotide
acaguggacuugcugcaua

SEQ ID NO: 13202 - RNA, 19 nt, Artificial Sequence
  Synthetic Oligonucleotide
guuuagacaacgucauccc

SEQ ID NO: 13203 - RNA, 19 nt, Artificial Sequence
  Synthetic Oligonucleotide
guucugccagaaauugugg

SEQ ID NO: 13204 - RNA, 19 nt, Artificial Sequence
  Synthetic Oligonucleotide
acucgauggggugccagcc

SEQ ID NO: 13205 - RNA, 19 nt, Artificial Sequence
  Synthetic Oligonucleotide
agaagucaccaagaagcua

SEQ ID NO: 13206 - RNA, 19 nt, Artificial Sequence
  Synthetic Oligonucleotide
gugugcggaaaggcacuga

SEQ ID NO: 13207 - RNA, 19 nt, Artificial Sequence
  Synthetic Oligonucleotide
gaggcuguuaaacauggcu

SEQ ID NO: 13208 - RNA, 19 nt, Artificial Sequence
  Synthetic Oligonucleotide
uguggaggcuguggaaggg

SEQ ID NO: 13209 - RNA, 19 nt, Artificial Sequence
  Synthetic Oligonucleotide
uuggugucgaaucaugggg

SEQ ID NO: 13210 - RNA, 19 nt, Artificial Sequence
  Synthetic Oligonucleotide
uucaaacugccgccacaac

SEQ ID NO: 13211 - RNA, 19 nt, Artificial Sequence
  Synthetic Oligonucleotide
ugaugaugccagggaggcu

SEQ ID NO: 13212 - RNA, 19 nt, Artificial Sequence
  Synthetic Oligonucleotide
uaugacuauuacaggucug

SEQ ID NO: 13213 - RNA, 19 nt, Artificial Sequence
  Synthetic Oligonucleotide
cgacaacucgauggggugc

SEQ ID NO: 13214 - RNA, 19 nt, Artificial Sequence
  Synthetic Oligonucleotide
uggugaggaaaaauccuuu

SEQ ID NO: 13215 - RNA, 19 nt, Artificial Sequence
  Synthetic Oligonucleotide
uaaaggaagaauuccgguu

SEQ ID NO: 13216 - RNA, 19 nt, Artificial Sequence
  Synthetic Oligonucleotide
cguaacagauucaaacugc

SEQ ID NO: 13217 - RNA, 19 nt, Artificial Sequence
  Synthetic Oligonucleotide
cuugccacugugagagccu

SEQ ID NO: 13218 - RNA, 19 nt, Artificial Sequence
  Synthetic Oligonucleotide
cugggaacgggcaugaugu

SEQ ID NO: 13219 - RNA, 19 nt, Artificial Sequence
  Synthetic Oligonucleotide
cugccagaaauuguggagg

SEQ ID NO: 13220 - RNA, 19 nt, Artificial Sequence
  Synthetic Oligonucleotide
auaugacuauuacaggucu

SEQ ID NO: 13221 - RNA, 19 nt, Artificial Sequence
  Synthetic Oligonucleotide
aacgggcaugauguugagu

SEQ ID NO: 13222 - RNA, 19 nt, Artificial Sequence
  Synthetic Oligonucleotide
aggcuguuaaacauggcuu

SEQ ID NO: 13223 - RNA, 19 nt, Artificial Sequence
  Synthetic Oligonucleotide
gcacugauguucugaaagc

SEQ ID NO: 13224 - RNA, 19 nt, Artificial Sequence
  Synthetic Oligonucleotide
ugggaucuuggugucgaau

SEQ ID NO: 13225 - RNA, 19 nt, Artificial Sequence
  Synthetic Oligonucleotide
gaccaaucguuuggggcuu

SEQ ID NO: 13226 - RNA, 19 nt, Artificial Sequence
  Synthetic Oligonucleotide
agacaacgucauccccugg

SEQ ID NO: 13227 - RNA, 19 nt, Artificial Sequence
  Synthetic Oligonucleotide
cugugcagagggugaccac

SEQ ID NO: 13228 - RNA, 19 nt, Artificial Sequence
  Synthetic Oligonucleotide
cucgauggggugccagcca

SEQ ID NO: 13229 - RNA, 19 nt, Artificial Sequence
  Synthetic Oligonucleotide
uaccugggcaaccgucugg

SEQ ID NO: 13230 - RNA, 19 nt, Artificial Sequence
  Synthetic Oligonucleotide
ggaagcuguauccaaggau

SEQ ID NO: 13231 - RNA, 19 nt, Artificial Sequence
  Synthetic Oligonucleotide
ggugucgaaucauggggcu

SEQ ID NO: 13232 - RNA, 19 nt, Artificial Sequence
  Synthetic Oligonucleotide
ugacuauuacaggucuggg

SEQ ID NO: 13233 - RNA, 19 nt, Artificial Sequence
  Synthetic Oligonucleotide
accugggcaaccgucugga

SEQ ID NO: 13234 - RNA, 19 nt, Artificial Sequence
  Synthetic Oligonucleotide
ugucgaaucauggggcucg

SEQ ID NO: 13235 - RNA, 19 nt, Artificial Sequence
  Synthetic Oligonucleotide
gccaccuccucaauugaag

SEQ ID NO: 13236 - RNA, 19 nt, Artificial Sequence
  Synthetic Oligonucleotide
aggcuguggaagggaaggu

SEQ ID NO: 13237 - RNA, 19 nt, Artificial Sequence
  Synthetic Oligonucleotide
uuuuaggacagagggucag

SEQ ID NO: 13238 - RNA, 19 nt, Artificial Sequence
  Synthetic Oligonucleotide
gaaaaauccuuuggccguu

SEQ ID NO: 13239 - RNA, 19 nt, Artificial Sequence
  Synthetic Oligonucleotide
ugauguucugaaagcucug

SEQ ID NO: 13240 - RNA, 19 nt, Artificial Sequence
  Synthetic Oligonucleotide
acuucuguuuuaggacaga

SEQ ID NO: 13241 - RNA, 19 nt, Artificial Sequence
  Synthetic Oligonucleotide
agggaagguggaagucuuc

SEQ ID NO: 13242 - RNA, 19 nt, Artificial Sequence
  Synthetic Oligonucleotide
uucuccugaggaaaauuuu

SEQ ID NO: 13243 - RNA, 19 nt, Artificial Sequence
  Synthetic Oligonucleotide
aagaagcuagugcggcagg

SEQ ID NO: 13244 - RNA, 19 nt, Artificial Sequence
  Synthetic Oligonucleotide
cuguggaagggaaggugga

SEQ ID NO: 13245 - RNA, 19 nt, Artificial Sequence
  Synthetic Oligonucleotide
ugaggcacuucguuggcug

SEQ ID NO: 13246 - RNA, 19 nt, Artificial Sequence
  Synthetic Oligonucleotide
gugcguaacagauucaaac

SEQ ID NO: 13247 - RNA, 19 nt, Artificial Sequence
  Synthetic Oligonucleotide
ccuuuggccguuuccaaga

SEQ ID NO: 13248 - RNA, 19 nt, Artificial Sequence
  Synthetic Oligonucleotide
gucgaaucauggggcucga

SEQ ID NO: 13249 - RNA, 19 nt, Artificial Sequence
  Synthetic Oligonucleotide
uuggccguuuccaagaucu

SEQ ID NO: 13250 - RNA, 19 nt, Artificial Sequence
  Synthetic Oligonucleotide
acgucauccccuggcaggc

SEQ ID NO: 13251 - RNA, 19 nt, Artificial Sequence
  Synthetic Oligonucleotide
ggugaggaaaaauccuuug

SEQ ID NO: 13252 - RNA, 19 nt, Artificial Sequence
  Synthetic Oligonucleotide
gugaugaugccagggaggc

SEQ ID NO: 13253 - RNA, 19 nt, Artificial Sequence
  Synthetic Oligonucleotide
cuaaaggaagaauuccggu

SEQ ID NO: 13254 - RNA, 19 nt, Artificial Sequence
  Synthetic Oligonucleotide
cuucuguuuuaggacagag

SEQ ID NO: 13255 - RNA, 19 nt, Artificial Sequence
  Synthetic Oligonucleotide
cuuuggccguuuccaagau

SEQ ID NO: 13256 - RNA, 19 nt, Artificial Sequence
  Synthetic Oligonucleotide
caccuccucaauugaagaa

SEQ ID NO: 13257 - RNA, 19 nt, Artificial Sequence
  Synthetic Oligonucleotide
uccuuuggccguuuccaag

SEQ ID NO: 13258 - RNA, 19 nt, Artificial Sequence
  Synthetic Oligonucleotide
gugucgaaucauggggcuc

SEQ ID NO: 13259 - RNA, 19 nt, Artificial Sequence
  Synthetic Oligonucleotide
gaggcuguggaagggaagg

SEQ ID NO: 13260 - RNA, 19 nt, Artificial Sequence
  Synthetic Oligonucleotide
uuguggaggcuguggaagg

SEQ ID NO: 13261 - RNA, 19 nt, Artificial Sequence
  Synthetic Oligonucleotide
caaucguuuggggcuuagc

SEQ ID NO: 13262 - RNA, 19 nt, Artificial Sequence
  Synthetic Oligonucleotide
ccagaaauuguggaggcug

SEQ ID NO: 13263 - RNA, 19 nt, Artificial Sequence
  Synthetic Oligonucleotide
ccugggcaaccgucuggau

SEQ ID NO: 13264 - RNA, 19 nt, Artificial Sequence
  Synthetic Oligonucleotide
ggaagcugguccugaggca

SEQ ID NO: 13265 - RNA, 19 nt, Artificial Sequence
  Synthetic Oligonucleotide
aacauggcuugaaugggau

SEQ ID NO: 13266 - RNA, 19 nt, Artificial Sequence
  Synthetic Oligonucleotide
aggcacuucguuggcugca

SEQ ID NO: 13267 - RNA, 19 nt, Artificial Sequence
  Synthetic Oligonucleotide
ugugagagccugucagucc

SEQ ID NO: 13268 - RNA, 19 nt, Artificial Sequence
  Synthetic Oligonucleotide
gaugccagggaggcuguua

SEQ ID NO: 13269 - RNA, 19 nt, Artificial Sequence
  Synthetic Oligonucleotide
auuggugaggaaaaauccu

SEQ ID NO: 13270 - RNA, 19 nt, Artificial Sequence
  Synthetic Oligonucleotide
ccacugugagagccuguca

SEQ ID NO: 13271 - RNA, 19 nt, Artificial Sequence
  Synthetic Oligonucleotide
ggacggcgagcuugccacu

SEQ ID NO: 13272 - RNA, 19 nt, Artificial Sequence
  Synthetic Oligonucleotide
gaagcugguccugaggcac

SEQ ID NO: 13273 - RNA, 19 nt, Artificial Sequence
  Synthetic Oligonucleotide
cccugggaacgggcaugau

SEQ ID NO: 13274 - RNA, 19 nt, Artificial Sequence
  Synthetic Oligonucleotide
augggaucuuggugucgaa

SEQ ID NO: 13275 - RNA, 19 nt, Artificial Sequence
  Synthetic Oligonucleotide
aguuccugggccaccuccu

SEQ ID NO: 13276 - RNA, 19 nt, Artificial Sequence
  Synthetic Oligonucleotide
aaaaauccuuuggccguuu

SEQ ID NO: 13277 - RNA, 19 nt, Artificial Sequence
  Synthetic Oligonucleotide
aagggaagguggaagucuu

SEQ ID NO: 13278 - RNA, 19 nt, Artificial Sequence
  Synthetic Oligonucleotide
ugaguuccugggccaccuc

SEQ ID NO: 13279 - RNA, 19 nt, Artificial Sequence
  Synthetic Oligonucleotide
aauugaagaaguggcggaa

SEQ ID NO: 13280 - RNA, 19 nt, Artificial Sequence
  Synthetic Oligonucleotide
aaucguuuggggcuuagcu

SEQ ID NO: 13281 - RNA, 19 nt, Artificial Sequence
  Synthetic Oligonucleotide
uuuggccguuuccaagauc

SEQ ID NO: 13282 - RNA, 19 nt, Artificial Sequence
  Synthetic Oligonucleotide
aggaagaauuccgguuggc

SEQ ID NO: 13283 - RNA, 19 nt, Artificial Sequence
  Synthetic Oligonucleotide
cagggaggcuguuaaacau

SEQ ID NO: 13284 - RNA, 19 nt, Artificial Sequence
  Synthetic Oligonucleotide
uguuuguggggagaccaau

SEQ ID NO: 13285 - RNA, 19 nt, Artificial Sequence
  Synthetic Oligonucleotide
cagaaauuguggaggcugu

SEQ ID NO: 13286 - RNA, 19 nt, Artificial Sequence
  Synthetic Oligonucleotide
gcaggcuaaagugcuguau

SEQ ID NO: 13287 - RNA, 19 nt, Artificial Sequence
  Synthetic Oligonucleotide
agagaagaugggcuacaag

SEQ ID NO: 13288 - RNA, 19 nt, Artificial Sequence
  Synthetic Oligonucleotide
gaagucaccaagaagcuag

SEQ ID NO: 13289 - RNA, 19 nt, Artificial Sequence
  Synthetic Oligonucleotide
uguggacggcgagcuugcc

SEQ ID NO: 13290 - RNA, 19 nt, Artificial Sequence
  Synthetic Oligonucleotide
cacugugagagccugucag

SEQ ID NO: 13291 - RNA, 19 nt, Artificial Sequence
  Synthetic Oligonucleotide
cuuuucaauggguguccua

SEQ ID NO: 13292 - RNA, 19 nt, Artificial Sequence
  Synthetic Oligonucleotide
cuguauccaaggaugcucc

SEQ ID NO: 13293 - RNA, 19 nt, Artificial Sequence
  Synthetic Oligonucleotide
uguugaguuccugggccac

SEQ ID NO: 13294 - RNA, 19 nt, Artificial Sequence
  Synthetic Oligonucleotide
aaaauccuuuggccguuuc

SEQ ID NO: 13295 - RNA, 19 nt, Artificial Sequence
  Synthetic Oligonucleotide
cuggcaggcuaaagugcug

SEQ ID NO: 13296 - RNA, 19 nt, Artificial Sequence
  Synthetic Oligonucleotide
aaauccuuuggccguuucc

SEQ ID NO: 13297 - RNA, 19 nt, Artificial Sequence
  Synthetic Oligonucleotide
aaauuguggaggcugugga

SEQ ID NO: 13298 - RNA, 19 nt, Artificial Sequence
  Synthetic Oligonucleotide
uggagagaauuggaauggg

SEQ ID NO: 13299 - RNA, 19 nt, Artificial Sequence
  Synthetic Oligonucleotide
ugauguugaguuccugggc

SEQ ID NO: 13300 - RNA, 19 nt, Artificial Sequence
  Synthetic Oligonucleotide
auguucugccagaaauugu

SEQ ID NO: 13301 - RNA, 19 nt, Artificial Sequence
  Synthetic Oligonucleotide
gaagcuagugcggcaggca

SEQ ID NO: 13302 - RNA, 19 nt, Artificial Sequence
  Synthetic Oligonucleotide
cgaaucauggggcucgaca

SEQ ID NO: 13303 - RNA, 19 nt, Artificial Sequence
  Synthetic Oligonucleotide
gccagggaggcuguuaaac

SEQ ID NO: 13304 - RNA, 19 nt, Artificial Sequence
  Synthetic Oligonucleotide
acuggagagaauuggaaug

SEQ ID NO: 13305 - RNA, 19 nt, Artificial Sequence
  Synthetic Oligonucleotide
cagagaagaugggcuacaa

SEQ ID NO: 13306 - RNA, 19 nt, Artificial Sequence
  Synthetic Oligonucleotide
gagaccaaucguuuggggc

SEQ ID NO: 13307 - RNA, 19 nt, Artificial Sequence
  Synthetic Oligonucleotide
auuguggaggcuguggaag

SEQ ID NO: 13308 - RNA, 19 nt, Artificial Sequence
  Synthetic Oligonucleotide
gaaucauggggcucgacaa

SEQ ID NO: 13309 - RNA, 19 nt, Artificial Sequence
  Synthetic Oligonucleotide
uccugaggcacuucguugg

SEQ ID NO: 13310 - RNA, 19 nt, Artificial Sequence
  Synthetic Oligonucleotide
gucccugggaacgggcaug

SEQ ID NO: 13311 - RNA, 19 nt, Artificial Sequence
  Synthetic Oligonucleotide
cugugagagccugucaguc

SEQ ID NO: 13312 - RNA, 19 nt, Artificial Sequence
  Synthetic Oligonucleotide
ggagagaauuggaaugggu

SEQ ID NO: 13313 - RNA, 19 nt, Artificial Sequence
  Synthetic Oligonucleotide
uggcucugagugggugcca

SEQ ID NO: 13314 - RNA, 19 nt, Artificial Sequence
  Synthetic Oligonucleotide
aagucaccaagaagcuagu

SEQ ID NO: 13315 - RNA, 19 nt, Artificial Sequence
  Synthetic Oligonucleotide
aaaggaagaauuccgguug

SEQ ID NO: 13316 - RNA, 19 nt, Artificial Sequence
  Synthetic Oligonucleotide
uggccguuuccaagaucug

SEQ ID NO: 13317 - RNA, 19 nt, Artificial Sequence
  Synthetic Oligonucleotide
auccuuuggccguuuccaa

SEQ ID NO: 13318 - RNA, 19 nt, Artificial Sequence
  Synthetic Oligonucleotide
ggcaggcagagaagauggg

SEQ ID NO: 13319 - RNA, 19 nt, Artificial Sequence
  Synthetic Oligonucleotide
gugagagccugucaguccc

SEQ ID NO: 13320 - RNA, 19 nt, Artificial Sequence
  Synthetic Oligonucleotide
uucugccagaaauugugga

SEQ ID NO: 13321 - RNA, 19 nt, Artificial Sequence
  Synthetic Oligonucleotide
agaagcuagugcggcaggc

SEQ ID NO: 13322 - RNA, 19 nt, Artificial Sequence
  Synthetic Oligonucleotide
gauucaaacugccgccaca

SEQ ID NO: 13323 - RNA, 19 nt, Artificial Sequence
  Synthetic Oligonucleotide
guuuguggggagaccaauc

SEQ ID NO: 13324 - RNA, 19 nt, Artificial Sequence
  Synthetic Oligonucleotide
guuuuaggacagaggguca

SEQ ID NO: 13325 - RNA, 19 nt, Artificial Sequence
  Synthetic Oligonucleotide
gggaagguggaagucuucc

SEQ ID NO: 13326 - RNA, 19 nt, Artificial Sequence
  Synthetic Oligonucleotide
uuggugaggaaaaauccuu

SEQ ID NO: 13327 - RNA, 19 nt, Artificial Sequence
  Synthetic Oligonucleotide
gacaacgucauccccuggc

SEQ ID NO: 13328 - RNA, 19 nt, Artificial Sequence
  Synthetic Oligonucleotide
uuuagacaacgucaucccc

SEQ ID NO: 13329 - RNA, 19 nt, Artificial Sequence
  Synthetic Oligonucleotide
gugaggaaaaauccuuugg

SEQ ID NO: 13330 - RNA, 19 nt, Artificial Sequence
  Synthetic Oligonucleotide
gcaggcagagaagaugggc

SEQ ID NO: 13331 - RNA, 19 nt, Artificial Sequence
  Synthetic Oligonucleotide
ccaccuccucaauugaaga

SEQ ID NO: 13332 - RNA, 19 nt, Artificial Sequence
  Synthetic Oligonucleotide
augauguugaguuccuggg

SEQ ID NO: 13333 - RNA, 19 nt, Artificial Sequence
  Synthetic Oligonucleotide
gagagaauuggaaugggug

SEQ ID NO: 13334 - RNA, 19 nt, Artificial Sequence
  Synthetic Oligonucleotide
cuccucaauugaagaagug

SEQ ID NO: 13335 - RNA, 19 nt, Artificial Sequence
  Synthetic Oligonucleotide
cuggagagaauuggaaugg

SEQ ID NO: 13336 - RNA, 19 nt, Artificial Sequence
  Synthetic Oligonucleotide
ccccuggcaggcuaaagug

SEQ ID NO: 13337 - RNA, 19 nt, Artificial Sequence
  Synthetic Oligonucleotide
ggaggcuguggaagggaag

SEQ ID NO: 13338 - RNA, 19 nt, Artificial Sequence
  Synthetic Oligonucleotide
auggcucugagugggugcc

SEQ ID NO: 13339 - RNA, 19 nt, Artificial Sequence
  Synthetic Oligonucleotide
agucaccaagaagcuagug

SEQ ID NO: 13340 - RNA, 19 nt, Artificial Sequence
  Synthetic Oligonucleotide
ugaagaaguggcggaagcu

SEQ ID NO: 13341 - RNA, 19 nt, Artificial Sequence
  Synthetic Oligonucleotide
gaguuccugggccaccucc

SEQ ID NO: 13342 - RNA, 19 nt, Artificial Sequence
  Synthetic Oligonucleotide
ccugaggcacuucguuggc

SEQ ID NO: 13343 - RNA, 19 nt, Artificial Sequence
  Synthetic Oligonucleotide
uuccugggccaccuccuca

SEQ ID NO: 13344 - RNA, 19 nt, Artificial Sequence
  Synthetic Oligonucleotide
guggaggcuguggaaggga

SEQ ID NO: 13345 - RNA, 19 nt, Artificial Sequence
  Synthetic Oligonucleotide
ucuuggugucgaaucaugg

SEQ ID NO: 13346 - RNA, 19 nt, Artificial Sequence
  Synthetic Oligonucleotide
uggaggcuguggaagggaa

SEQ ID NO: 13347 - RNA, 19 nt, Artificial Sequence
  Synthetic Oligonucleotide
gggaucuuggugucgaauc

SEQ ID NO: 13348 - RNA, 19 nt, Artificial Sequence
  Synthetic Oligonucleotide
ucccugggaacgggcauga

SEQ ID NO: 13349 - RNA, 19 nt, Artificial Sequence
  Synthetic Oligonucleotide
uuugagaggugaugaugcc

SEQ ID NO: 13350 - RNA, 19 nt, Artificial Sequence
  Synthetic Oligonucleotide
auggcuugaaugggaucuu

SEQ ID NO: 13351 - RNA, 19 nt, Artificial Sequence
  Synthetic Oligonucleotide
cauggcucugagugggugc

SEQ ID NO: 13352 - RNA, 19 nt, Artificial Sequence
  Synthetic Oligonucleotide
agaggugaugaugccaggg

SEQ ID NO: 13353 - RNA, 19 nt, Artificial Sequence
  Synthetic Oligonucleotide
cgagcuugccacugugaga

SEQ ID NO: 13354 - RNA, 19 nt, Artificial Sequence
  Synthetic Oligonucleotide
guugaguuccugggccacc

SEQ ID NO: 13355 - RNA, 19 nt, Artificial Sequence
  Synthetic Oligonucleotide
ggcgagcuugccacuguga

SEQ ID NO: 13356 - RNA, 19 nt, Artificial Sequence
  Synthetic Oligonucleotide
auguggacggcgagcuugc

SEQ ID NO: 13357 - RNA, 19 nt, Artificial Sequence
  Synthetic Oligonucleotide
aauuguggaggcuguggaa

SEQ ID NO: 13358 - RNA, 19 nt, Artificial Sequence
  Synthetic Oligonucleotide
auugaagaaguggcggaag

SEQ ID NO: 13359 - RNA, 19 nt, Artificial Sequence
  Synthetic Oligonucleotide
acaacucgauggggugcca

SEQ ID NO: 13360 - RNA, 19 nt, Artificial Sequence
  Synthetic Oligonucleotide
ggaagaauuccgguuggcc

SEQ ID NO: 13361 - RNA, 19 nt, Artificial Sequence
  Synthetic Oligonucleotide
ggcagagaagaugggcuac

SEQ ID NO: 13362 - RNA, 19 nt, Artificial Sequence
  Synthetic Oligonucleotide
accaaucguuuggggcuua

SEQ ID NO: 13363 - RNA, 19 nt, Artificial Sequence
  Synthetic Oligonucleotide
ugaggaaaaauccuuuggc

SEQ ID NO: 13364 - RNA, 19 nt, Artificial Sequence
  Synthetic Oligonucleotide
aacgucauccccuggcagg

SEQ ID NO: 13365 - RNA, 19 nt, Artificial Sequence
  Synthetic Oligonucleotide
acugugagagccugucagu

SEQ ID NO: 13366 - RNA, 19 nt, Artificial Sequence
  Synthetic Oligonucleotide
cgucauccccuggcaggcu

SEQ ID NO: 13367 - RNA, 19 nt, Artificial Sequence
  Synthetic Oligonucleotide
acaacgucauccccuggca

SEQ ID NO: 13368 - RNA, 19 nt, Artificial Sequence
  Synthetic Oligonucleotide
aaucauggggcucgacaac

SEQ ID NO: 13369 - RNA, 19 nt, Artificial Sequence
  Synthetic Oligonucleotide
aauccuuuggccguuucca

SEQ ID NO: 13370 - RNA, 19 nt, Artificial Sequence
  Synthetic Oligonucleotide
cccuggcaggcuaaagugc

SEQ ID NO: 13371 - RNA, 19 nt, Artificial Sequence
  Synthetic Oligonucleotide
cuuggugucgaaucauggg

SEQ ID NO: 13372 - RNA, 19 nt, Artificial Sequence
  Synthetic Oligonucleotide
cauguggacggcgagcuug

SEQ ID NO: 13373 - RNA, 19 nt, Artificial Sequence
  Synthetic Oligonucleotide
agaauuccgguuggccaug

SEQ ID NO: 13374 - RNA, 19 nt, Artificial Sequence
  Synthetic Oligonucleotide
caccaagaagcuagugcgg

SEQ ID NO: 13375 - RNA, 19 nt, Artificial Sequence
  Synthetic Oligonucleotide
gaagguggaagucuuccug

SEQ ID NO: 13376 - RNA, 19 nt, Artificial Sequence
  Synthetic Oligonucleotide
gauguugaguuccugggcc

SEQ ID NO: 13377 - RNA, 19 nt, Artificial Sequence
  Synthetic Oligonucleotide
ccuuaccugggcaaccguc

SEQ ID NO: 13378 - RNA, 19 nt, Artificial Sequence
  Synthetic Oligonucleotide
gacaacucgauggggugcc

SEQ ID NO: 13379 - RNA, 19 nt, Artificial Sequence
  Synthetic Oligonucleotide
gagaggugaugaugccagg

SEQ ID NO: 13380 - RNA, 19 nt, Artificial Sequence
  Synthetic Oligonucleotide
ugggcaaccgucuggauga

SEQ ID NO: 13381 - RNA, 19 nt, Artificial Sequence
  Synthetic Oligonucleotide
ccuggcaggcuaaagugcu

SEQ ID NO: 13382 - RNA, 19 nt, Artificial Sequence
  Synthetic Oligonucleotide
gcgagcuugccacugugag

SEQ ID NO: 13383 - RNA, 19 nt, Artificial Sequence
  Synthetic Oligonucleotide
aagaaguggcggaagcugg

SEQ ID NO: 13384 - RNA, 19 nt, Artificial Sequence
  Synthetic Oligonucleotide
gcuagugcggcaggcagag

SEQ ID NO: 13385 - RNA, 19 nt, Artificial Sequence
  Synthetic Oligonucleotide
uuuguggggagaccaaucg

SEQ ID NO: 13386 - RNA, 19 nt, Artificial Sequence
  Synthetic Oligonucleotide
gaauuccgguuggccaugg

SEQ ID NO: 13387 - RNA, 19 nt, Artificial Sequence
  Synthetic Oligonucleotide
caugauguugaguuccugg

SEQ ID NO: 13388 - RNA, 19 nt, Artificial Sequence
  Synthetic Oligonucleotide
aggugaugaugccagggag

SEQ ID NO: 13389 - RNA, 19 nt, Artificial Sequence
  Synthetic Oligonucleotide
aagcuagugcggcaggcag

SEQ ID NO: 13390 - RNA, 19 nt, Artificial Sequence
  Synthetic Oligonucleotide
caacucgauggggugccag

SEQ ID NO: 13391 - RNA, 19 nt, Artificial Sequence
  Synthetic Oligonucleotide
gacggcgagcuugccacug

SEQ ID NO: 13392 - RNA, 19 nt, Artificial Sequence
  Synthetic Oligonucleotide
aaggaagaauuccgguugg

SEQ ID NO: 13393 - RNA, 19 nt, Artificial Sequence
  Synthetic Oligonucleotide
gcucgacaacucgaugggg

SEQ ID NO: 13394 - RNA, 19 nt, Artificial Sequence
  Synthetic Oligonucleotide
cacuggagagaauuggaau

SEQ ID NO: 13395 - RNA, 19 nt, Artificial Sequence
  Synthetic Oligonucleotide
gaggugaugaugccaggga

SEQ ID NO: 13396 - RNA, 19 nt, Artificial Sequence
  Synthetic Oligonucleotide
ucugccagaaauuguggag

SEQ ID NO: 13397 - RNA, 19 nt, Artificial Sequence
  Synthetic Oligonucleotide
uugaagaaguggcggaagc

SEQ ID NO: 13398 - RNA, 19 nt, Artificial Sequence
  Synthetic Oligonucleotide
ggagaccaaucguuugggg

SEQ ID NO: 13399 - RNA, 19 nt, Artificial Sequence
  Synthetic Oligonucleotide
uggacggcgagcuugccac

SEQ ID NO: 13400 - RNA, 19 nt, Artificial Sequence
  Synthetic Oligonucleotide
acaccuuaccugggcaacc

SEQ ID NO: 13401 - RNA, 19 nt, Artificial Sequence
  Synthetic Oligonucleotide
ggaucuuggugucgaauca

SEQ ID NO: 13402 - RNA, 19 nt, Artificial Sequence
  Synthetic Oligonucleotide
accaagaagcuagugcggc

SEQ ID NO: 13403 - RNA, 19 nt, Artificial Sequence
  Synthetic Oligonucleotide
uugaguuccugggccaccu

SEQ ID NO: 13404 - RNA, 19 nt, Artificial Sequence
  Synthetic Oligonucleotide
cagucccugggaacgggca

SEQ ID NO: 13405 - RNA, 19 nt, Artificial Sequence
  Synthetic Oligonucleotide
ucgacaacucgauggggug

SEQ ID NO: 13406 - RNA, 19 nt, Artificial Sequence
  Synthetic Oligonucleotide
gaucuuggugucgaaucau

SEQ ID NO: 13407 - RNA, 19 nt, Artificial Sequence
  Synthetic Oligonucleotide
agcuagugcggcaggcaga

SEQ ID NO: 13408 - RNA, 19 nt, Artificial Sequence
  Synthetic Oligonucleotide
acggcgagcuugccacugu

SEQ ID NO: 13409 - RNA, 19 nt, Artificial Sequence
  Synthetic Oligonucleotide
cugaggcacuucguuggcu

SEQ ID NO: 13410 - RNA, 19 nt, Artificial Sequence
  Synthetic Oligonucleotide
gggcaugauguugaguucc

SEQ ID NO: 13411 - RNA, 19 nt, Artificial Sequence
  Synthetic Oligonucleotide
cggcgagcuugccacugug

SEQ ID NO: 13412 - RNA, 19 nt, Artificial Sequence
  Synthetic Oligonucleotide
ugagagccugucagucccu

SEQ ID NO: 13413 - RNA, 19 nt, Artificial Sequence
  Synthetic Oligonucleotide
gucagucccugggaacggg

SEQ ID NO: 13414 - RNA, 19 nt, Artificial Sequence
  Synthetic Oligonucleotide
gccguuuccaagaucugac

SEQ ID NO: 13415 - RNA, 19 nt, Artificial Sequence
  Synthetic Oligonucleotide
gcagagaagaugggcuaca

SEQ ID NO: 13416 - RNA, 19 nt, Artificial Sequence
  Synthetic Oligonucleotide
acgggcaugauguugaguu

SEQ ID NO: 13417 - RNA, 19 nt, Artificial Sequence
  Synthetic Oligonucleotide
uuaccugggcaaccgucug

SEQ ID NO: 13418 - RNA, 19 nt, Artificial Sequence
  Synthetic Oligonucleotide
agucccugggaacgggcau

SEQ ID NO: 13419 - RNA, 19 nt, Artificial Sequence
  Synthetic Oligonucleotide
aagcugguccugaggcacu

SEQ ID NO: 13420 - RNA, 19 nt, Artificial Sequence
  Synthetic Oligonucleotide
ggaagguggaagucuuccu

SEQ ID NO: 13421 - RNA, 19 nt, Artificial Sequence
  Synthetic Oligonucleotide
ucagucccugggaacgggc

SEQ ID NO: 13422 - RNA, 19 nt, Artificial Sequence
  Synthetic Oligonucleotide
gagagccugucagucccug

SEQ ID NO: 13423 - RNA, 19 nt, Artificial Sequence
  Synthetic Oligonucleotide
accuuaccugggcaaccgu

SEQ ID NO: 13424 - RNA, 19 nt, Artificial Sequence
  Synthetic Oligonucleotide
cauggggcucgacaacucg

SEQ ID NO: 13425 - RNA, 19 nt, Artificial Sequence
  Synthetic Oligonucleotide
caugcagcgcauggcucau

SEQ ID NO: 13426 - RNA, 19 nt, Artificial Sequence
  Synthetic Oligonucleotide
gggagaccaaucguuuggg

SEQ ID NO: 13427 - RNA, 19 nt, Artificial Sequence
  Synthetic Oligonucleotide
cauccccuggcaggcuaaa

SEQ ID NO: 13428 - RNA, 19 nt, Artificial Sequence
  Synthetic Oligonucleotide
uguggggagaccaaucguu

SEQ ID NO: 13429 - RNA, 19 nt, Artificial Sequence
  Synthetic Oligonucleotide
caagaagcuagugcggcag

SEQ ID NO: 13430 - RNA, 19 nt, Artificial Sequence
  Synthetic Oligonucleotide
caacgucauccccuggcag

SEQ ID NO: 13431 - RNA, 19 nt, Artificial Sequence
  Synthetic Oligonucleotide
cgggcaugauguugaguuc

SEQ ID NO: 13432 - RNA, 19 nt, Artificial Sequence
  Synthetic Oligonucleotide
uugagaggugaugaugcca

SEQ ID NO: 13433 - RNA, 19 nt, Artificial Sequence
  Synthetic Oligonucleotide
uguucugaaagcucuggcu

SEQ ID NO: 13434 - RNA, 19 nt, Artificial Sequence
  Synthetic Oligonucleotide
guggacggcgagcuugcca

SEQ ID NO: 13435 - RNA, 19 nt, Artificial Sequence
  Synthetic Oligonucleotide
ccagggaggcuguuaaaca

SEQ ID NO: 13436 - RNA, 19 nt, Artificial Sequence
  Synthetic Oligonucleotide
uagacaacgucauccccug

SEQ ID NO: 13437 - RNA, 19 nt, Artificial Sequence
  Synthetic Oligonucleotide
cugggcaaccgucuggaug

SEQ ID NO: 13438 - RNA, 19 nt, Artificial Sequence
  Synthetic Oligonucleotide
auccccuggcaggcuaaag

SEQ ID NO: 13439 - RNA, 19 nt, Artificial Sequence
  Synthetic Oligonucleotide
cuggaaauauauuaacugu

SEQ ID NO: 13440 - RNA, 19 nt, Artificial Sequence
  Synthetic Oligonucleotide
uaaugaucucauuguuuau

SEQ ID NO: 13441 - RNA, 19 nt, Artificial Sequence
  Synthetic Oligonucleotide
aagauaaugaucucauugu

SEQ ID NO: 13442 - RNA, 19 nt, Artificial Sequence
  Synthetic Oligonucleotide
uggaaauauauuaacuguu

SEQ ID NO: 13443 - RNA, 19 nt, Artificial Sequence
  Synthetic Oligonucleotide
uucagcauguauuacuuga

SEQ ID NO: 13444 - RNA, 19 nt, Artificial Sequence
  Synthetic Oligonucleotide
uccuggaaauauauuaacu

SEQ ID NO: 13445 - RNA, 19 nt, Artificial Sequence
  Synthetic Oligonucleotide
aaagauaaugaucucauug

SEQ ID NO: 13446 - RNA, 19 nt, Artificial Sequence
  Synthetic Oligonucleotide
aaauuuugaaaccaguacu

SEQ ID NO: 13447 - RNA, 19 nt, Artificial Sequence
  Synthetic Oligonucleotide
uugaaaccaguacuuuauc

SEQ ID NO: 13448 - RNA, 19 nt, Artificial Sequence
  Synthetic Oligonucleotide
ccuggaaauauauuaacug

SEQ ID NO: 13449 - RNA, 19 nt, Artificial Sequence
  Synthetic Oligonucleotide
aacaaaauagcaaucccuu

SEQ ID NO: 13450 - RNA, 19 nt, Artificial Sequence
  Synthetic Oligonucleotide
auaaugaucucauuguuua

SEQ ID NO: 13451 - RNA, 19 nt, Artificial Sequence
  Synthetic Oligonucleotide
aacagugguucuuaaauug

SEQ ID NO: 13452 - RNA, 19 nt, Artificial Sequence
  Synthetic Oligonucleotide
ggacuuucauccuggaaau

SEQ ID NO: 13453 - RNA, 19 nt, Artificial Sequence
  Synthetic Oligonucleotide
uuaugaacaacaugcuaaa

SEQ ID NO: 13454 - RNA, 19 nt, Artificial Sequence
  Synthetic Oligonucleotide
gugaaaagauaaugaucuc

SEQ ID NO: 13455 - RNA, 19 nt, Artificial Sequence
  Synthetic Oligonucleotide
uggugauacuucuuugaau

SEQ ID NO: 13456 - RNA, 19 nt, Artificial Sequence
  Synthetic Oligonucleotide
agaagacugacaucauugc

SEQ ID NO: 13457 - RNA, 19 nt, Artificial Sequence
  Synthetic Oligonucleotide
uggacuuucauccuggaaa

SEQ ID NO: 13458 - RNA, 19 nt, Artificial Sequence
  Synthetic Oligonucleotide
ucauccuggaaauauauua

SEQ ID NO: 13459 - RNA, 19 nt, Artificial Sequence
  Synthetic Oligonucleotide
gagaagacugacaucauug

SEQ ID NO: 13460 - RNA, 19 nt, Artificial Sequence
  Synthetic Oligonucleotide
aauuggugauacuucuuug

SEQ ID NO: 13461 - RNA, 19 nt, Artificial Sequence
  Synthetic Oligonucleotide
cucauuguuuauuaaccug

SEQ ID NO: 13462 - RNA, 19 nt, Artificial Sequence
  Synthetic Oligonucleotide
aggugaaaagauaaugauc

SEQ ID NO: 13463 - RNA, 19 nt, Artificial Sequence
  Synthetic Oligonucleotide
uuucauccuggaaauauau

SEQ ID NO: 13464 - RNA, 19 nt, Artificial Sequence
  Synthetic Oligonucleotide
acaaaauagcaaucccuuu

SEQ ID NO: 13465 - RNA, 19 nt, Artificial Sequence
  Synthetic Oligonucleotide
agauaaugaucucauuguu

SEQ ID NO: 13466 - RNA, 19 nt, Artificial Sequence
  Synthetic Oligonucleotide
cuuucauccuggaaauaua

SEQ ID NO: 13467 - RNA, 19 nt, Artificial Sequence
  Synthetic Oligonucleotide
uagcaaucccuuuuauuuc

SEQ ID NO: 13468 - RNA, 19 nt, Artificial Sequence
  Synthetic Oligonucleotide
caaaauagcaaucccuuuu

SEQ ID NO: 13469 - RNA, 19 nt, Artificial Sequence
  Synthetic Oligonucleotide
ucagcauguauuacuugac

SEQ ID NO: 13470 - RNA, 19 nt, Artificial Sequence
  Synthetic Oligonucleotide
guaauuggugauacuucuu

SEQ ID NO: 13471 - RNA, 19 nt, Artificial Sequence
  Synthetic Oligonucleotide
gggauagcaauaaccugug

SEQ ID NO: 13472 - RNA, 19 nt, Artificial Sequence
  Synthetic Oligonucleotide
ucauuguuuauuaaccugu

SEQ ID NO: 13473 - RNA, 19 nt, Artificial Sequence
  Synthetic Oligonucleotide
cacaacucaggaugaaaaa

SEQ ID NO: 13474 - RNA, 19 nt, Artificial Sequence
  Synthetic Oligonucleotide
uucauccuggaaauauauu

SEQ ID NO: 13475 - RNA, 19 nt, Artificial Sequence
  Synthetic Oligonucleotide
ugggauagcaauaaccugu

SEQ ID NO: 13476 - RNA, 19 nt, Artificial Sequence
  Synthetic Oligonucleotide
uaauuggugauacuucuuu

SEQ ID NO: 13477 - RNA, 19 nt, Artificial Sequence
  Synthetic Oligonucleotide
augaaaaauuuugaaacca

SEQ ID NO: 13478 - RNA, 19 nt, Artificial Sequence
  Synthetic Oligonucleotide
aauuuguaucaaugauuau

SEQ ID NO: 13479 - RNA, 19 nt, Artificial Sequence
  Synthetic Oligonucleotide
ggcuaauuuguaucaauga

SEQ ID NO: 13480 - RNA, 19 nt, Artificial Sequence
  Synthetic Oligonucleotide
gucugaauauauccaaaug

SEQ ID NO: 13481 - RNA, 19 nt, Artificial Sequence
  Synthetic Oligonucleotide
aaacagugguucuuaaauu

SEQ ID NO: 13482 - RNA, 19 nt, Artificial Sequence
  Synthetic Oligonucleotide
ugaucucauuguuuauuaa

SEQ ID NO: 13483 - RNA, 19 nt, Artificial Sequence
  Synthetic Oligonucleotide
ucucauuguuuauuaaccu

SEQ ID NO: 13484 - RNA, 19 nt, Artificial Sequence
  Synthetic Oligonucleotide
uuuuuuucagcauguauua

SEQ ID NO: 13485 - RNA, 19 nt, Artificial Sequence
  Synthetic Oligonucleotide
aaccaguacuuuaucauuu

SEQ ID NO: 13486 - RNA, 19 nt, Artificial Sequence
  Synthetic Oligonucleotide
guaaugccugauucacaac

SEQ ID NO: 13487 - RNA, 19 nt, Artificial Sequence
  Synthetic Oligonucleotide
aaaauuuugaaaccaguac

SEQ ID NO: 13488 - RNA, 19 nt, Artificial Sequence
  Synthetic Oligonucleotide
auagcaaucccuuuuauuu

SEQ ID NO: 13489 - RNA, 19 nt, Artificial Sequence
  Synthetic Oligonucleotide
cggcuaauuuguaucaaug

SEQ ID NO: 13490 - RNA, 19 nt, Artificial Sequence
  Synthetic Oligonucleotide
auccuggaaauauauuaac

SEQ ID NO: 13491 - RNA, 19 nt, Artificial Sequence
  Synthetic Oligonucleotide
aaaagauaaugaucucauu

SEQ ID NO: 13492 - RNA, 19 nt, Artificial Sequence
  Synthetic Oligonucleotide
cugaauauauccaaauguu

SEQ ID NO: 13493 - RNA, 19 nt, Artificial Sequence
  Synthetic Oligonucleotide
uaauuuguaucaaugauua

SEQ ID NO: 13494 - RNA, 19 nt, Artificial Sequence
  Synthetic Oligonucleotide
acugacaucauugccaauu

SEQ ID NO: 13495 - RNA, 19 nt, Artificial Sequence
  Synthetic Oligonucleotide
aaugauuaugaacaacaug

SEQ ID NO: 13496 - RNA, 19 nt, Artificial Sequence
  Synthetic Oligonucleotide
aaaauagcaaucccuuuua

SEQ ID NO: 13497 - RNA, 19 nt, Artificial Sequence
  Synthetic Oligonucleotide
ggauagcaauaaccuguga

SEQ ID NO: 13498 - RNA, 19 nt, Artificial Sequence
  Synthetic Oligonucleotide
gcuaauuuguaucaaugau

SEQ ID NO: 13499 - RNA, 19 nt, Artificial Sequence
  Synthetic Oligonucleotide
ugaacaacaugcuaaauca

SEQ ID NO: 13500 - RNA, 19 nt, Artificial Sequence
  Synthetic Oligonucleotide
uuauuucauugcuuuugac

SEQ ID NO: 13501 - RNA, 19 nt, Artificial Sequence
  Synthetic Oligonucleotide
aaauuguaagcucagguuc

SEQ ID NO: 13502 - RNA, 19 nt, Artificial Sequence
  Synthetic Oligonucleotide
gacugacaucauugccaau

SEQ ID NO: 13503 - RNA, 19 nt, Artificial Sequence
  Synthetic Oligonucleotide
aaugaucucauuguuuauu

SEQ ID NO: 13504 - RNA, 19 nt, Artificial Sequence
  Synthetic Oligonucleotide
ugauuaugaacaacaugcu

SEQ ID NO: 13505 - RNA, 19 nt, Artificial Sequence
  Synthetic Oligonucleotide
aaauggacuuucauccugg

SEQ ID NO: 13506 - RNA, 19 nt, Artificial Sequence
  Synthetic Oligonucleotide
aaaguguugguaaugccug

SEQ ID NO: 13507 - RNA, 19 nt, Artificial Sequence
  Synthetic Oligonucleotide
uuguaucaaugauuaugaa

SEQ ID NO: 13508 - RNA, 19 nt, Artificial Sequence
  Synthetic Oligonucleotide
caaucccuuuuauuucauu

SEQ ID NO: 13509 - RNA, 19 nt, Artificial Sequence
  Synthetic Oligonucleotide
cgguaauuggugauacuuc

SEQ ID NO: 13510 - RNA, 19 nt, Artificial Sequence
  Synthetic Oligonucleotide
ucgacaagacauuggugag

SEQ ID NO: 13511 - RNA, 19 nt, Artificial Sequence
  Synthetic Oligonucleotide
aauagcaaucccuuuuauu

SEQ ID NO: 13512 - RNA, 19 nt, Artificial Sequence
  Synthetic Oligonucleotide
uguugguaaugccugauuc

SEQ ID NO: 13513 - RNA, 19 nt, Artificial Sequence
  Synthetic Oligonucleotide
auauuaacuguuaaaaaga

SEQ ID NO: 13514 - RNA, 19 nt, Artificial Sequence
  Synthetic Oligonucleotide
cucaggaugaaaaauuuug

SEQ ID NO: 13515 - RNA, 19 nt, Artificial Sequence
  Synthetic Oligonucleotide
cugggauagcaauaaccug

SEQ ID NO: 13516 - RNA, 19 nt, Artificial Sequence
  Synthetic Oligonucleotide
aaaaauuuugaaaccagua

SEQ ID NO: 13517 - RNA, 19 nt, Artificial Sequence
  Synthetic Oligonucleotide
uuggugauacuucuuugaa

SEQ ID NO: 13518 - RNA, 19 nt, Artificial Sequence
  Synthetic Oligonucleotide
uaucaaugauuaugaacaa

SEQ ID NO: 13519 - RNA, 19 nt, Artificial Sequence
  Synthetic Oligonucleotide
guaagcucagguucaaagu

SEQ ID NO: 13520 - RNA, 19 nt, Artificial Sequence
  Synthetic Oligonucleotide
cuaauuuguaucaaugauu

SEQ ID NO: 13521 - RNA, 19 nt, Artificial Sequence
  Synthetic Oligonucleotide
uauuucauugcuuuugacu

SEQ ID NO: 13522 - RNA, 19 nt, Artificial Sequence
  Synthetic Oligonucleotide
ucugaauauauccaaaugu

SEQ ID NO: 13523 - RNA, 19 nt, Artificial Sequence
  Synthetic Oligonucleotide
augauuaugaacaacaugc

SEQ ID NO: 13524 - RNA, 19 nt, Artificial Sequence
  Synthetic Oligonucleotide
auauauuaacuguuaaaaa

SEQ ID NO: 13525 - RNA, 19 nt, Artificial Sequence
  Synthetic Oligonucleotide
guugguaaugccugauuca

SEQ ID NO: 13526 - RNA, 19 nt, Artificial Sequence
  Synthetic Oligonucleotide
aggaugaaaaauuuugaaa

SEQ ID NO: 13527 - RNA, 19 nt, Artificial Sequence
  Synthetic Oligonucleotide
uuuugaaaccaguacuuua

SEQ ID NO: 13528 - RNA, 19 nt, Artificial Sequence
  Synthetic Oligonucleotide
uuccaaagucuauauauga

SEQ ID NO: 13529 - RNA, 19 nt, Artificial Sequence
  Synthetic Oligonucleotide
aacucaggaugaaaaauuu

SEQ ID NO: 13530 - RNA, 19 nt, Artificial Sequence
  Synthetic Oligonucleotide
uuauuaaccuguauucugu

SEQ ID NO: 13531 - RNA, 19 nt, Artificial Sequence
  Synthetic Oligonucleotide
uuucagcauguauuacuug

SEQ ID NO: 13532 - RNA, 19 nt, Artificial Sequence
  Synthetic Oligonucleotide
cacaauauuuucccaucug

SEQ ID NO: 13533 - RNA, 19 nt, Artificial Sequence
  Synthetic Oligonucleotide
gucuguaauuccccacuuc

SEQ ID NO: 13534 - RNA, 19 nt, Artificial Sequence
  Synthetic Oligonucleotide
ucaaaguguugguaaugcc

SEQ ID NO: 13535 - RNA, 19 nt, Artificial Sequence
  Synthetic Oligonucleotide
uaaagugcuguauccuuua

SEQ ID NO: 13536 - RNA, 19 nt, Artificial Sequence
  Synthetic Oligonucleotide
gacuuucauccuggaaaua

SEQ ID NO: 13537 - RNA, 19 nt, Artificial Sequence
  Synthetic Oligonucleotide
cuggaugaugugcguaaca

SEQ ID NO: 13538 - RNA, 19 nt, Artificial Sequence
  Synthetic Oligonucleotide
ugugaaagucaucgacaag

SEQ ID NO: 13539 - RNA, 19 nt, Artificial Sequence
  Synthetic Oligonucleotide
acucaggaugaaaaauuuu

SEQ ID NO: 13540 - RNA, 19 nt, Artificial Sequence
  Synthetic Oligonucleotide
ggaaauauauuaacuguua

SEQ ID NO: 13541 - RNA, 19 nt, Artificial Sequence
  Synthetic Oligonucleotide
uuuuucagcauguauuacu

SEQ ID NO: 13542 - RNA, 19 nt, Artificial Sequence
  Synthetic Oligonucleotide
uuuucagcauguauuacuu

SEQ ID NO: 13543 - RNA, 19 nt, Artificial Sequence
  Synthetic Oligonucleotide
ugcacaauauuuucccauc

SEQ ID NO: 13544 - RNA, 19 nt, Artificial Sequence
  Synthetic Oligonucleotide
caaacacuaaggugaaaag

SEQ ID NO: 13545 - RNA, 19 nt, Artificial Sequence
  Synthetic Oligonucleotide
agaaugugaaagucaucga

SEQ ID NO: 13546 - RNA, 19 nt, Artificial Sequence
  Synthetic Oligonucleotide
ugaaaaauuuugaaaccag

SEQ ID NO: 13547 - RNA, 19 nt, Artificial Sequence
  Synthetic Oligonucleotide
auggacuuucauccuggaa

SEQ ID NO: 13548 - RNA, 19 nt, Artificial Sequence
  Synthetic Oligonucleotide
uaaauuguaagcucagguu

SEQ ID NO: 13549 - RNA, 19 nt, Artificial Sequence
  Synthetic Oligonucleotide
cauccuggaaauauauuaa

SEQ ID NO: 13550 - RNA, 19 nt, Artificial Sequence
  Synthetic Oligonucleotide
uauauuaacuguuaaaaag

SEQ ID NO: 13551 - RNA, 19 nt, Artificial Sequence
  Synthetic Oligonucleotide
aaucccuuuuauuucauug

SEQ ID NO: 13552 - RNA, 19 nt, Artificial Sequence
  Synthetic Oligonucleotide
auccaaauguuuuaggaug

SEQ ID NO: 13553 - RNA, 19 nt, Artificial Sequence
  Synthetic Oligonucleotide
cuguuaaaaagaaaacauu

SEQ ID NO: 13554 - RNA, 19 nt, Artificial Sequence
  Synthetic Oligonucleotide
agacugacaucauugccaa

SEQ ID NO: 13555 - RNA, 19 nt, Artificial Sequence
  Synthetic Oligonucleotide
uuugaaaccaguacuuuau

SEQ ID NO: 13556 - RNA, 19 nt, Artificial Sequence
  Synthetic Oligonucleotide
cacuauugauguucugcca

SEQ ID NO: 13557 - RNA, 19 nt, Artificial Sequence
  Synthetic Oligonucleotide
gaaauauauuaacuguuaa

SEQ ID NO: 13558 - RNA, 19 nt, Artificial Sequence
  Synthetic Oligonucleotide
aucccuuuuauuucauugc

SEQ ID NO: 13559 - RNA, 19 nt, Artificial Sequence
  Synthetic Oligonucleotide
aucucauuguuuauuaacc

SEQ ID NO: 13560 - RNA, 19 nt, Artificial Sequence
  Synthetic Oligonucleotide
uggaugaugugcguaacag

SEQ ID NO: 13561 - RNA, 19 nt, Artificial Sequence
  Synthetic Oligonucleotide
gaaauggacuuucauccug

SEQ ID NO: 13562 - RNA, 19 nt, Artificial Sequence
  Synthetic Oligonucleotide
aauuuugaaaccaguacuu

SEQ ID NO: 13563 - RNA, 19 nt, Artificial Sequence
  Synthetic Oligonucleotide
ccacaacucaggaugaaaa

SEQ ID NO: 13564 - RNA, 19 nt, Artificial Sequence
  Synthetic Oligonucleotide
agcauguauuacuugacaa

SEQ ID NO: 13565 - RNA, 19 nt, Artificial Sequence
  Synthetic Oligonucleotide
uuaaauuguaagcucaggu

SEQ ID NO: 13566 - RNA, 19 nt, Artificial Sequence
  Synthetic Oligonucleotide
uuguuuauuaaccuguauu

SEQ ID NO: 13567 - RNA, 19 nt, Artificial Sequence
  Synthetic Oligonucleotide
ugaaaccaguacuuuauca

SEQ ID NO: 13568 - RNA, 19 nt, Artificial Sequence
  Synthetic Oligonucleotide
cagaaugugaaagucaucg

SEQ ID NO: 13569 - RNA, 19 nt, Artificial Sequence
  Synthetic Oligonucleotide
guaucaaugauuaugaaca

SEQ ID NO: 13570 - RNA, 19 nt, Artificial Sequence
  Synthetic Oligonucleotide
gauaaugaucucauuguuu

SEQ ID NO: 13571 - RNA, 19 nt, Artificial Sequence
  Synthetic Oligonucleotide
cuguauucuguuuacaugu

SEQ ID NO: 13572 - RNA, 19 nt, Artificial Sequence
  Synthetic Oligonucleotide
caauauuuucccaucugua

SEQ ID NO: 13573 - RNA, 19 nt, Artificial Sequence
  Synthetic Oligonucleotide
uuagugucugaauauaucc

SEQ ID NO: 13574 - RNA, 19 nt, Artificial Sequence
  Synthetic Oligonucleotide
gcacaauauuuucccaucu

SEQ ID NO: 13575 - RNA, 19 nt, Artificial Sequence
  Synthetic Oligonucleotide
gucguucuuuuccaacaaa

SEQ ID NO: 13576 - RNA, 19 nt, Artificial Sequence
  Synthetic Oligonucleotide
cugacaucauugccaauug

SEQ ID NO: 13577 - RNA, 19 nt, Artificial Sequence
  Synthetic Oligonucleotide
aaguguugguaaugccuga

SEQ ID NO: 13578 - RNA, 19 nt, Artificial Sequence
  Synthetic Oligonucleotide
gaagacugacaucauugcc

SEQ ID NO: 13579 - RNA, 19 nt, Artificial Sequence
  Synthetic Oligonucleotide
gaaaagauaaugaucucau

SEQ ID NO: 13580 - RNA, 19 nt, Artificial Sequence
  Synthetic Oligonucleotide
acaacucaggaugaaaaau

SEQ ID NO: 13581 - RNA, 19 nt, Artificial Sequence
  Synthetic Oligonucleotide
cugauaauauugcagcauu

SEQ ID NO: 13582 - RNA, 19 nt, Artificial Sequence
  Synthetic Oligonucleotide
gaaaccaguacuuuaucau

SEQ ID NO: 13583 - RNA, 19 nt, Artificial Sequence
  Synthetic Oligonucleotide
acaauauuuucccaucugu

SEQ ID NO: 13584 - RNA, 19 nt, Artificial Sequence
  Synthetic Oligonucleotide
accaguacuuuaucauuuu

SEQ ID NO: 13585 - RNA, 19 nt, Artificial Sequence
  Synthetic Oligonucleotide
aucaguacuuccaaagucu

SEQ ID NO: 13586 - RNA, 19 nt, Artificial Sequence
  Synthetic Oligonucleotide
cacuaaggugaaaagauaa

SEQ ID NO: 13587 - RNA, 19 nt, Artificial Sequence
  Synthetic Oligonucleotide
uaagcucagguucaaagug

SEQ ID NO: 13588 - RNA, 19 nt, Artificial Sequence
  Synthetic Oligonucleotide
ggcugagaagacugacauc

SEQ ID NO: 13589 - RNA, 19 nt, Artificial Sequence
  Synthetic Oligonucleotide
aaggugaaaagauaaugau

SEQ ID NO: 13590 - RNA, 19 nt, Artificial Sequence
  Synthetic Oligonucleotide
ccagaaugugaaagucauc

SEQ ID NO: 13591 - RNA, 19 nt, Artificial Sequence
  Synthetic Oligonucleotide
cagcauguauuacuugaca

SEQ ID NO: 13592 - RNA, 19 nt, Artificial Sequence
  Synthetic Oligonucleotide
uucauugcuuuugacuuuu

SEQ ID NO: 13593 - RNA, 19 nt, Artificial Sequence
  Synthetic Oligonucleotide
acuaaggugaaaagauaau

SEQ ID NO: 13594 - RNA, 19 nt, Artificial Sequence
  Synthetic Oligonucleotide
ugccugauucacaacuuug

SEQ ID NO: 13595 - RNA, 19 nt, Artificial Sequence
  Synthetic Oligonucleotide
agcaaucccuuuuauuuca

SEQ ID NO: 13596 - RNA, 19 nt, Artificial Sequence
  Synthetic Oligonucleotide
uuuauuucauugcuuuuga

SEQ ID NO: 13597 - RNA, 19 nt, Artificial Sequence
  Synthetic Oligonucleotide
cagucuguaauuccccacu

SEQ ID NO: 13598 - RNA, 19 nt, Artificial Sequence
  Synthetic Oligonucleotide
ggugauacuucuuugaaug

SEQ ID NO: 13599 - RNA, 19 nt, Artificial Sequence
  Synthetic Oligonucleotide
aucaaugauuaugaacaac

SEQ ID NO: 13600 - RNA, 19 nt, Artificial Sequence
  Synthetic Oligonucleotide
aagugcuguauccuuuagu

SEQ ID NO: 13601 - RNA, 19 nt, Artificial Sequence
  Synthetic Oligonucleotide
gugucguucuuuuccaaca

SEQ ID NO: 13602 - RNA, 19 nt, Artificial Sequence
  Synthetic Oligonucleotide
caacaaaauagcaaucccu

SEQ ID NO: 13603 - RNA, 19 nt, Artificial Sequence
  Synthetic Oligonucleotide
agucuguaauuccccacuu

SEQ ID NO: 13604 - RNA, 19 nt, Artificial Sequence
  Synthetic Oligonucleotide
ugaaagucaucgacaagac

SEQ ID NO: 13605 - RNA, 19 nt, Artificial Sequence
  Synthetic Oligonucleotide
uguuuauuaaccuguauuc

SEQ ID NO: 13606 - RNA, 19 nt, Artificial Sequence
  Synthetic Oligonucleotide
guauguuacuucuuagaga

SEQ ID NO: 13607 - RNA, 19 nt, Artificial Sequence
  Synthetic Oligonucleotide
uauccaaauguuuuaggau

SEQ ID NO: 13608 - RNA, 19 nt, Artificial Sequence
  Synthetic Oligonucleotide
ugguucuuaaauuguaagc

SEQ ID NO: 13609 - RNA, 19 nt, Artificial Sequence
  Synthetic Oligonucleotide
uccaacaaaauagcaaucc

SEQ ID NO: 13610 - RNA, 19 nt, Artificial Sequence
  Synthetic Oligonucleotide
augaacaacaugcuaaauc

SEQ ID NO: 13611 - RNA, 19 nt, Artificial Sequence
  Synthetic Oligonucleotide
gcaaacacuaaggugaaaa

SEQ ID NO: 13612 - RNA, 19 nt, Artificial Sequence
  Synthetic Oligonucleotide
ccggcuaauuuguaucaau

SEQ ID NO: 13613 - RNA, 19 nt, Artificial Sequence
  Synthetic Oligonucleotide
aaauagcaaucccuuuuau

SEQ ID NO: 13614 - RNA, 19 nt, Artificial Sequence
  Synthetic Oligonucleotide
aauggacuuucauccugga

SEQ ID NO: 13615 - RNA, 19 nt, Artificial Sequence
  Synthetic Oligonucleotide
uggcugauaauauugcagc

SEQ ID NO: 13616 - RNA, 19 nt, Artificial Sequence
  Synthetic Oligonucleotide
ccaacaaaauagcaauccc

SEQ ID NO: 13617 - RNA, 19 nt, Artificial Sequence
  Synthetic Oligonucleotide
aaauguuuuaggauguaug

SEQ ID NO: 13618 - RNA, 19 nt, Artificial Sequence
  Synthetic Oligonucleotide
uuuagugucugaauauauc

SEQ ID NO: 13619 - RNA, 19 nt, Artificial Sequence
  Synthetic Oligonucleotide
ucccuuuuauuucauugcu

SEQ ID NO: 13620 - RNA, 19 nt, Artificial Sequence
  Synthetic Oligonucleotide
gugucugaauauauccaaa

SEQ ID NO: 13621 - RNA, 19 nt, Artificial Sequence
  Synthetic Oligonucleotide
gccagaaugugaaagucau

SEQ ID NO: 13622 - RNA, 19 nt, Artificial Sequence
  Synthetic Oligonucleotide
gaaaaauuuugaaaccagu

SEQ ID NO: 13623 - RNA, 19 nt, Artificial Sequence
  Synthetic Oligonucleotide
uuuuuucagcauguauuac

SEQ ID NO: 13624 - RNA, 19 nt, Artificial Sequence
  Synthetic Oligonucleotide
ugucugaauauauccaaau

SEQ ID NO: 13625 - RNA, 19 nt, Artificial Sequence
  Synthetic Oligonucleotide
ggaugaaaaauuuugaaac

SEQ ID NO: 13626 - RNA, 19 nt, Artificial Sequence
  Synthetic Oligonucleotide
ucaggaugaaaaauuuuga

SEQ ID NO: 13627 - RNA, 19 nt, Artificial Sequence
  Synthetic Oligonucleotide
uccaaagucuauauaugac

SEQ ID NO: 13628 - RNA, 19 nt, Artificial Sequence
  Synthetic Oligonucleotide
uagugucugaauauaucca

SEQ ID NO: 13629 - RNA, 19 nt, Artificial Sequence
  Synthetic Oligonucleotide
caaugauuaugaacaacau

SEQ ID NO: 13630 - RNA, 19 nt, Artificial Sequence
  Synthetic Oligonucleotide
uguuaaaaagaaaacauug

SEQ ID NO: 13631 - RNA, 19 nt, Artificial Sequence
  Synthetic Oligonucleotide
ggugaaaagauaaugaucu

SEQ ID NO: 13632 - RNA, 19 nt, Artificial Sequence
  Synthetic Oligonucleotide
ugucguucuuuuccaacaa

SEQ ID NO: 13633 - RNA, 19 nt, Artificial Sequence
  Synthetic Oligonucleotide
agugcuguauccuuuagua

SEQ ID NO: 13634 - RNA, 19 nt, Artificial Sequence
  Synthetic Oligonucleotide
aaagugcuguauccuuuag

SEQ ID NO: 13635 - RNA, 19 nt, Artificial Sequence
  Synthetic Oligonucleotide
caaagucuauauaugacua

SEQ ID NO: 13636 - RNA, 19 nt, Artificial Sequence
  Synthetic Oligonucleotide
uucaaaguguugguaaugc

SEQ ID NO: 13637 - RNA, 19 nt, Artificial Sequence
  Synthetic Oligonucleotide
gcgguaauuggugauacuu

SEQ ID NO: 13638 - RNA, 19 nt, Artificial Sequence
  Synthetic Oligonucleotide
uccaaauguuuuaggaugu

SEQ ID NO: 13639 - RNA, 19 nt, Artificial Sequence
  Synthetic Oligonucleotide
ugauacuucuuugaaugua

SEQ ID NO: 13640 - RNA, 19 nt, Artificial Sequence
  Synthetic Oligonucleotide
augaucucauuguuuauua

SEQ ID NO: 13641 - RNA, 19 nt, Artificial Sequence
  Synthetic Oligonucleotide
ccaaauguuuuaggaugua

SEQ ID NO: 13642 - RNA, 19 nt, Artificial Sequence
  Synthetic Oligonucleotide
cugagaagacugacaucau

SEQ ID NO: 13643 - RNA, 19 nt, Artificial Sequence
  Synthetic Oligonucleotide
uaacuguuaaaaagaaaac

SEQ ID NO: 13644 - RNA, 19 nt, Artificial Sequence
  Synthetic Oligonucleotide
acuauugauguucugccag

SEQ ID NO: 13645 - RNA, 19 nt, Artificial Sequence
  Synthetic Oligonucleotide
aaaacagugguucuuaaau

SEQ ID NO: 13646 - RNA, 19 nt, Artificial Sequence
  Synthetic Oligonucleotide
acuuucauccuggaaauau

SEQ ID NO: 13647 - RNA, 19 nt, Artificial Sequence
  Synthetic Oligonucleotide
aacuuuggcugauaauauu

SEQ ID NO: 13648 - RNA, 19 nt, Artificial Sequence
  Synthetic Oligonucleotide
uuaucauuuucuccugagg

SEQ ID NO: 13649 - RNA, 19 nt, Artificial Sequence
  Synthetic Oligonucleotide
aaaucaguacuuccaaagu

SEQ ID NO: 13650 - RNA, 19 nt, Artificial Sequence
  Synthetic Oligonucleotide
ccuuuuauuucauugcuuu

SEQ ID NO: 13651 - RNA, 19 nt, Artificial Sequence
  Synthetic Oligonucleotide
agaaauggacuuucauccu

SEQ ID NO: 13652 - RNA, 19 nt, Artificial Sequence
  Synthetic Oligonucleotide
uacuuccaaagucuauaua

SEQ ID NO: 13653 - RNA, 19 nt, Artificial Sequence
  Synthetic Oligonucleotide
agggugucguucuuuucca

SEQ ID NO: 13654 - RNA, 19 nt, Artificial Sequence
  Synthetic Oligonucleotide
uaaggugaaaagauaauga

SEQ ID NO: 13655 - RNA, 19 nt, Artificial Sequence
  Synthetic Oligonucleotide
uguauuacuugacaaagag

SEQ ID NO: 13656 - RNA, 19 nt, Artificial Sequence
  Synthetic Oligonucleotide
augaugugcguaacagauu

SEQ ID NO: 13657 - RNA, 19 nt, Artificial Sequence
  Synthetic Oligonucleotide
gaugaaaaauuuugaaacc

SEQ ID NO: 13658 - RNA, 19 nt, Artificial Sequence
  Synthetic Oligonucleotide
gcugauaauauugcagcau

SEQ ID NO: 13659 - RNA, 19 nt, Artificial Sequence
  Synthetic Oligonucleotide
ucuggaugaugugcguaac

SEQ ID NO: 13660 - RNA, 19 nt, Artificial Sequence
  Synthetic Oligonucleotide
aucgacaagacauugguga

SEQ ID NO: 13661 - RNA, 19 nt, Artificial Sequence
  Synthetic Oligonucleotide
caaaguguugguaaugccu

SEQ ID NO: 13662 - RNA, 19 nt, Artificial Sequence
  Synthetic Oligonucleotide
caaauggcugagaagacug

SEQ ID NO: 13663 - RNA, 19 nt, Artificial Sequence
  Synthetic Oligonucleotide
augaagaaacuuuggcuga

SEQ ID NO: 13664 - RNA, 19 nt, Artificial Sequence
  Synthetic Oligonucleotide
ugaaaagauaaugaucuca

SEQ ID NO: 13665 - RNA, 19 nt, Artificial Sequence
  Synthetic Oligonucleotide
uuuguaucaaugauuauga

SEQ ID NO: 13666 - RNA, 19 nt, Artificial Sequence
  Synthetic Oligonucleotide
aagacugacaucauugcca

SEQ ID NO: 13667 - RNA, 19 nt, Artificial Sequence
  Synthetic Oligonucleotide
guagcaaacacuaagguga

SEQ ID NO: 13668 - RNA, 19 nt, Artificial Sequence
  Synthetic Oligonucleotide
ggugccagaaugugaaagu

SEQ ID NO: 13669 - RNA, 19 nt, Artificial Sequence
  Synthetic Oligonucleotide
agccacuauugauguucug

SEQ ID NO: 13670 - RNA, 19 nt, Artificial Sequence
  Synthetic Oligonucleotide
auuuugaaaccaguacuuu

SEQ ID NO: 13671 - RNA, 19 nt, Artificial Sequence
  Synthetic Oligonucleotide
ucuguaauuccccacuuca

SEQ ID NO: 13672 - RNA, 19 nt, Artificial Sequence
  Synthetic Oligonucleotide
gauagcaauaaccugugaa

SEQ ID NO: 13673 - RNA, 19 nt, Artificial Sequence
  Synthetic Oligonucleotide
uuaacuguuaaaaagaaaa

SEQ ID NO: 13674 - RNA, 19 nt, Artificial Sequence
  Synthetic Oligonucleotide
gccacaacucaggaugaaa

SEQ ID NO: 13675 - RNA, 19 nt, Artificial Sequence
  Synthetic Oligonucleotide
ucagguucaaaguguuggu

SEQ ID NO: 13676 - RNA, 19 nt, Artificial Sequence
  Synthetic Oligonucleotide
uuaaccuguauucuguuua

SEQ ID NO: 13677 - RNA, 19 nt, Artificial Sequence
  Synthetic Oligonucleotide
caaucacaucuuuaguguc

SEQ ID NO: 13678 - RNA, 19 nt, Artificial Sequence
  Synthetic Oligonucleotide
uuguaagcucagguucaaa

SEQ ID NO: 13679 - RNA, 19 nt, Artificial Sequence
  Synthetic Oligonucleotide
uucuuugaauguagauuuc

SEQ ID NO: 13680 - RNA, 19 nt, Artificial Sequence
  Synthetic Oligonucleotide
ccggaauguugcugaaaca

SEQ ID NO: 13681 - RNA, 19 nt, Artificial Sequence
  Synthetic Oligonucleotide
auuaacuguuaaaaagaaa

SEQ ID NO: 13682 - RNA, 19 nt, Artificial Sequence
  Synthetic Oligonucleotide
aaauauauuaacuguuaaa

SEQ ID NO: 13683 - RNA, 19 nt, Artificial Sequence
  Synthetic Oligonucleotide
caaauguuuuaggauguau

SEQ ID NO: 13684 - RNA, 19 nt, Artificial Sequence
  Synthetic Oligonucleotide
auuuguaucaaugauuaug

SEQ ID NO: 13685 - RNA, 19 nt, Artificial Sequence
  Synthetic Oligonucleotide
uuuaaaacagugguucuua

SEQ ID NO: 13686 - RNA, 19 nt, Artificial Sequence
  Synthetic Oligonucleotide
gaagaaacuuuggcugaua

SEQ ID NO: 13687 - RNA, 19 nt, Artificial Sequence
  Synthetic Oligonucleotide
ccaagaucugacagugcac

SEQ ID NO: 13688 - RNA, 19 nt, Artificial Sequence
  Synthetic Oligonucleotide
cuaaggugaaaagauaaug

SEQ ID NO: 13689 - RNA, 19 nt, Artificial Sequence
  Synthetic Oligonucleotide
uaauauugcagcauuuucc

SEQ ID NO: 13690 - RNA, 19 nt, Artificial Sequence
  Synthetic Oligonucleotide
gguagcaaacacuaaggug

SEQ ID NO: 13691 - RNA, 19 nt, Artificial Sequence
  Synthetic Oligonucleotide
uugguaaugccugauucac

SEQ ID NO: 13692 - RNA, 19 nt, Artificial Sequence
  Synthetic Oligonucleotide
aaugugaaagucaucgaca

SEQ ID NO: 13693 - RNA, 19 nt, Artificial Sequence
  Synthetic Oligonucleotide
uuaaaacagugguucuuaa

SEQ ID NO: 13694 - RNA, 19 nt, Artificial Sequence
  Synthetic Oligonucleotide
ccuguauucuguuuacaug

SEQ ID NO: 13695 - RNA, 19 nt, Artificial Sequence
  Synthetic Oligonucleotide
ugagaagacugacaucauu

SEQ ID NO: 13696 - RNA, 19 nt, Artificial Sequence
  Synthetic Oligonucleotide
ucuuaaauuguaagcucag

SEQ ID NO: 13697 - RNA, 19 nt, Artificial Sequence
  Synthetic Oligonucleotide
uagcaaacacuaaggugaa

SEQ ID NO: 13698 - RNA, 19 nt, Artificial Sequence
  Synthetic Oligonucleotide
cucagguucaaaguguugg

SEQ ID NO: 13699 - RNA, 19 nt, Artificial Sequence
  Synthetic Oligonucleotide
gacaagacauuggugagga

SEQ ID NO: 13700 - RNA, 19 nt, Artificial Sequence
  Synthetic Oligonucleotide
agguagcaaacacuaaggu

SEQ ID NO: 13701 - RNA, 19 nt, Artificial Sequence
  Synthetic Oligonucleotide
uaaaacagugguucuuaaa

SEQ ID NO: 13702 - RNA, 19 nt, Artificial Sequence
  Synthetic Oligonucleotide
guucaaaguguugguaaug

SEQ ID NO: 13703 - RNA, 19 nt, Artificial Sequence
  Synthetic Oligonucleotide
uauuaaccuguauucuguu

SEQ ID NO: 13704 - RNA, 19 nt, Artificial Sequence
  Synthetic Oligonucleotide
guguugguaaugccugauu

SEQ ID NO: 13705 - RNA, 19 nt, Artificial Sequence
  Synthetic Oligonucleotide
ucaguacuuccaaagucua

SEQ ID NO: 13706 - RNA, 19 nt, Artificial Sequence
  Synthetic Oligonucleotide
caguacuuccaaagucuau

SEQ ID NO: 13707 - RNA, 19 nt, Artificial Sequence
  Synthetic Oligonucleotide
ucaaugauuaugaacaaca

SEQ ID NO: 13708 - RNA, 19 nt, Artificial Sequence
  Synthetic Oligonucleotide
uguucaagauguccucgag

SEQ ID NO: 13709 - RNA, 19 nt, Artificial Sequence
  Synthetic Oligonucleotide
cuuuaaaacagugguucuu

SEQ ID NO: 13710 - RNA, 19 nt, Artificial Sequence
  Synthetic Oligonucleotide
gaucucauuguuuauuaac

SEQ ID NO: 13711 - RNA, 19 nt, Artificial Sequence
  Synthetic Oligonucleotide
aguguugguaaugccugau

SEQ ID NO: 13712 - RNA, 19 nt, Artificial Sequence
  Synthetic Oligonucleotide
acaacaugcuaaaucagua

SEQ ID NO: 13713 - RNA, 19 nt, Artificial Sequence
  Synthetic Oligonucleotide
uucuuaaauuguaagcuca

SEQ ID NO: 13714 - RNA, 19 nt, Artificial Sequence
  Synthetic Oligonucleotide
uucguuggcugcaacugua

SEQ ID NO: 13715 - RNA, 19 nt, Artificial Sequence
  Synthetic Oligonucleotide
uaaaucaguacuuccaaag

SEQ ID NO: 13716 - RNA, 19 nt, Artificial Sequence
  Synthetic Oligonucleotide
acaagacauuggugaggaa

SEQ ID NO: 13717 - RNA, 19 nt, Artificial Sequence
  Synthetic Oligonucleotide
gcauguauuacuugacaaa

SEQ ID NO: 13718 - RNA, 19 nt, Artificial Sequence
  Synthetic Oligonucleotide
gugauacuucuuugaaugu

SEQ ID NO: 13719 - RNA, 19 nt, Artificial Sequence
  Synthetic Oligonucleotide
caagaucugacagugcaca

SEQ ID NO: 13720 - RNA, 19 nt, Artificial Sequence
  Synthetic Oligonucleotide
acaucuuuagugucugaau

SEQ ID NO: 13721 - RNA, 19 nt, Artificial Sequence
  Synthetic Oligonucleotide
agcaaacacuaaggugaaa

SEQ ID NO: 13722 - RNA, 19 nt, Artificial Sequence
  Synthetic Oligonucleotide
auagcaauaaccugugaaa

SEQ ID NO: 13723 - RNA, 19 nt, Artificial Sequence
  Synthetic Oligonucleotide
aauauauuaacuguuaaaa

SEQ ID NO: 13724 - RNA, 19 nt, Artificial Sequence
  Synthetic Oligonucleotide
ugaugugcguaacagauuc

SEQ ID NO: 13725 - RNA, 19 nt, Artificial Sequence
  Synthetic Oligonucleotide
aaucaguacuuccaaaguc

SEQ ID NO: 13726 - RNA, 19 nt, Artificial Sequence
  Synthetic Oligonucleotide
gguaauuggugauacuucu

SEQ ID NO: 13727 - RNA, 19 nt, Artificial Sequence
  Synthetic Oligonucleotide
uuccaacaaaauagcaauc

SEQ ID NO: 13728 - RNA, 19 nt, Artificial Sequence
  Synthetic Oligonucleotide
uguaagcucagguucaaag

SEQ ID NO: 13729 - RNA, 19 nt, Artificial Sequence
  Synthetic Oligonucleotide
aucugacagugcacaauau

SEQ ID NO: 13730 - RNA, 19 nt, Artificial Sequence
  Synthetic Oligonucleotide
uugcagcauuuuccagaug

SEQ ID NO: 13731 - RNA, 19 nt, Artificial Sequence
  Synthetic Oligonucleotide
gugguucuuaaauuguaag

SEQ ID NO: 13732 - RNA, 19 nt, Artificial Sequence
  Synthetic Oligonucleotide
ugaugaagaaacuuuggcu

SEQ ID NO: 13733 - RNA, 19 nt, Artificial Sequence
  Synthetic Oligonucleotide
aaacacuaaggugaaaaga

SEQ ID NO: 13734 - RNA, 19 nt, Artificial Sequence
  Synthetic Oligonucleotide
auuguuuauuaaccuguau

SEQ ID NO: 13735 - RNA, 19 nt, Artificial Sequence
  Synthetic Oligonucleotide
cgccacaacucaggaugaa

SEQ ID NO: 13736 - RNA, 19 nt, Artificial Sequence
  Synthetic Oligonucleotide
agaaacuuuggcugauaau

SEQ ID NO: 13737 - RNA, 19 nt, Artificial Sequence
  Synthetic Oligonucleotide
gugcacaauauuuucccau

SEQ ID NO: 13738 - RNA, 19 nt, Artificial Sequence
  Synthetic Oligonucleotide
gugaaagucaucgacaaga

SEQ ID NO: 13739 - RNA, 19 nt, Artificial Sequence
  Synthetic Oligonucleotide
gauuaugaacaacaugcua

SEQ ID NO: 13740 - RNA, 19 nt, Artificial Sequence
  Synthetic Oligonucleotide
accuguauucuguuuacau

SEQ ID NO: 13741 - RNA, 19 nt, Artificial Sequence
  Synthetic Oligonucleotide
ugauaauauugcagcauuu

SEQ ID NO: 13742 - RNA, 19 nt, Artificial Sequence
  Synthetic Oligonucleotide
auauuuucccaucuguauu

SEQ ID NO: 13743 - RNA, 19 nt, Artificial Sequence
  Synthetic Oligonucleotide
uguauguuacuucuuagag

SEQ ID NO: 13744 - RNA, 19 nt, Artificial Sequence
  Synthetic Oligonucleotide
ucaucgacaagacauuggu

SEQ ID NO: 13745 - RNA, 19 nt, Artificial Sequence
  Synthetic Oligonucleotide
agcucagguucaaaguguu

SEQ ID NO: 13746 - RNA, 19 nt, Artificial Sequence
  Synthetic Oligonucleotide
auguauuacuugacaaaga

SEQ ID NO: 13747 - RNA, 19 nt, Artificial Sequence
  Synthetic Oligonucleotide
cauguauuacuugacaaag

SEQ ID NO: 13748 - RNA, 19 nt, Artificial Sequence
  Synthetic Oligonucleotide
ggugucguucuuuuccaac

SEQ ID NO: 13749 - RNA, 19 nt, Artificial Sequence
  Synthetic Oligonucleotide
ccaaagucuauauaugacu

SEQ ID NO: 13750 - RNA, 19 nt, Artificial Sequence
  Synthetic Oligonucleotide
gagguagcaaacacuaagg

SEQ ID NO: 13751 - RNA, 19 nt, Artificial Sequence
  Synthetic Oligonucleotide
auaucaaauggcugagaag

SEQ ID NO: 13752 - RNA, 19 nt, Artificial Sequence
  Synthetic Oligonucleotide
aaaccaguacuuuaucauu

SEQ ID NO: 13753 - RNA, 19 nt, Artificial Sequence
  Synthetic Oligonucleotide
gguaaugccugauucacaa

SEQ ID NO: 13754 - RNA, 19 nt, Artificial Sequence
  Synthetic Oligonucleotide
ccacuauugauguucugcc

SEQ ID NO: 13755 - RNA, 19 nt, Artificial Sequence
  Synthetic Oligonucleotide
guuuauuaaccuguauucu

SEQ ID NO: 13756 - RNA, 19 nt, Artificial Sequence
  Synthetic Oligonucleotide
cuauugauguucugccaga

SEQ ID NO: 13757 - RNA, 19 nt, Artificial Sequence
  Synthetic Oligonucleotide
caggaugaaaaauuuugaa

SEQ ID NO: 13758 - RNA, 19 nt, Artificial Sequence
  Synthetic Oligonucleotide
uaucauuuucuccugagga

SEQ ID NO: 13759 - RNA, 19 nt, Artificial Sequence
  Synthetic Oligonucleotide
ugguaaugccugauucaca

SEQ ID NO: 13760 - RNA, 19 nt, Artificial Sequence
  Synthetic Oligonucleotide
aaccuguauucuguuuaca

SEQ ID NO: 13761 - RNA, 19 nt, Artificial Sequence
  Synthetic Oligonucleotide
aagucaucgacaagacauu

SEQ ID NO: 13762 - RNA, 19 nt, Artificial Sequence
  Synthetic Oligonucleotide
ugaagaaacuuuggcugau

SEQ ID NO: 13763 - RNA, 19 nt, Artificial Sequence
  Synthetic Oligonucleotide
acagugguucuuaaauugu

SEQ ID NO: 13764 - RNA, 19 nt, Artificial Sequence
  Synthetic Oligonucleotide
aauauauccaaauguuuua

SEQ ID NO: 13765 - RNA, 19 nt, Artificial Sequence
  Synthetic Oligonucleotide
caagacauuggugaggaaa

SEQ ID NO: 13766 - RNA, 19 nt, Artificial Sequence
  Synthetic Oligonucleotide
ucugacagugcacaauauu

SEQ ID NO: 13767 - RNA, 19 nt, Artificial Sequence
  Synthetic Oligonucleotide
gugccagaaugugaaaguc

SEQ ID NO: 13768 - RNA, 19 nt, Artificial Sequence
  Synthetic Oligonucleotide
ugaauguagauuuccaauc

SEQ ID NO: 13769 - RNA, 19 nt, Artificial Sequence
  Synthetic Oligonucleotide
acuguuaaaaagaaaacau

SEQ ID NO: 13770 - RNA, 19 nt, Artificial Sequence
  Synthetic Oligonucleotide
uaugaacaacaugcuaaau

SEQ ID NO: 13771 - RNA, 19 nt, Artificial Sequence
  Synthetic Oligonucleotide
uguaucaaugauuaugaac

SEQ ID NO: 13772 - RNA, 19 nt, Artificial Sequence
  Synthetic Oligonucleotide
guauucuguuuacaugucu

SEQ ID NO: 13773 - RNA, 19 nt, Artificial Sequence
  Synthetic Oligonucleotide
caacucaggaugaaaaauu

SEQ ID NO: 13774 - RNA, 19 nt, Artificial Sequence
  Synthetic Oligonucleotide
auauccaaauguuuuagga

SEQ ID NO: 13775 - RNA, 19 nt, Artificial Sequence
  Synthetic Oligonucleotide
ggcgguaauuggugauacu

SEQ ID NO: 13776 - RNA, 19 nt, Artificial Sequence
  Synthetic Oligonucleotide
gaugaagaaacuuuggcug

SEQ ID NO: 13777 - RNA, 19 nt, Artificial Sequence
  Synthetic Oligonucleotide
uuucauugcuuuugacuuu

SEQ ID NO: 13778 - RNA, 19 nt, Artificial Sequence
  Synthetic Oligonucleotide
agugucugaauauauccaa

SEQ ID NO: 13779 - RNA, 19 nt, Artificial Sequence
  Synthetic Oligonucleotide
cauuguuuauuaaccugua

SEQ ID NO: 13780 - RNA, 19 nt, Artificial Sequence
  Synthetic Oligonucleotide
auauauccaaauguuuuag

SEQ ID NO: 13781 - RNA, 19 nt, Artificial Sequence
  Synthetic Oligonucleotide
gacagugcacaauauuuuc

SEQ ID NO: 13782 - RNA, 19 nt, Artificial Sequence
  Synthetic Oligonucleotide
uaaccuguauucuguuuac

SEQ ID NO: 13783 - RNA, 19 nt, Artificial Sequence
  Synthetic Oligonucleotide
uaaugccugauucacaacu

SEQ ID NO: 13784 - RNA, 19 nt, Artificial Sequence
  Synthetic Oligonucleotide
uauugauguucugccagaa

SEQ ID NO: 13785 - RNA, 19 nt, Artificial Sequence
  Synthetic Oligonucleotide
uugaauguagauuuccaau

SEQ ID NO: 13786 - RNA, 19 nt, Artificial Sequence
  Synthetic Oligonucleotide
cccuuuuauuucauugcuu

SEQ ID NO: 13787 - RNA, 19 nt, Artificial Sequence
  Synthetic Oligonucleotide
ugccagaaugugaaaguca

SEQ ID NO: 13788 - RNA, 19 nt, Artificial Sequence
  Synthetic Oligonucleotide
gaaugugaaagucaucgac

SEQ ID NO: 13789 - RNA, 19 nt, Artificial Sequence
  Synthetic Oligonucleotide
ggaugaugugcguaacaga

SEQ ID NO: 13790 - RNA, 19 nt, Artificial Sequence
  Synthetic Oligonucleotide
aagcucagguucaaagugu

SEQ ID NO: 13791 - RNA, 19 nt, Artificial Sequence
  Synthetic Oligonucleotide
uauucuguuuacaugucuu

SEQ ID NO: 13792 - RNA, 19 nt, Artificial Sequence
  Synthetic Oligonucleotide
cgacaagacauuggugagg

SEQ ID NO: 13793 - RNA, 19 nt, Artificial Sequence
  Synthetic Oligonucleotide
uaguaaaauuggagguagc

SEQ ID NO: 13794 - RNA, 19 nt, Artificial Sequence
  Synthetic Oligonucleotide
aguacuuccaaagucuaua

SEQ ID NO: 13795 - RNA, 19 nt, Artificial Sequence
  Synthetic Oligonucleotide
gaauguagauuuccaauca

SEQ ID NO: 13796 - RNA, 19 nt, Artificial Sequence
  Synthetic Oligonucleotide
uccaagaucugacagugca

SEQ ID NO: 13797 - RNA, 19 nt, Artificial Sequence
  Synthetic Oligonucleotide
auacuucuuugaauguaga

SEQ ID NO: 13798 - RNA, 19 nt, Artificial Sequence
  Synthetic Oligonucleotide
ggcugauaauauugcagca

SEQ ID NO: 13799 - RNA, 19 nt, Artificial Sequence
  Synthetic Oligonucleotide
augcuaaaucaguacuucc

SEQ ID NO: 13800 - RNA, 19 nt, Artificial Sequence
  Synthetic Oligonucleotide
uagagagaaauaaagcauu

SEQ ID NO: 13801 - RNA, 19 nt, Artificial Sequence
  Synthetic Oligonucleotide
gaauauauccaaauguuuu

SEQ ID NO: 13802 - RNA, 19 nt, Artificial Sequence
  Synthetic Oligonucleotide
uuuuauuucauugcuuuug

SEQ ID NO: 13803 - RNA, 19 nt, Artificial Sequence
  Synthetic Oligonucleotide
acagugcacaauauuuucc

SEQ ID NO: 13804 - RNA, 19 nt, Artificial Sequence
  Synthetic Oligonucleotide
aucacaucuuuagugucug

SEQ ID NO: 13805 - RNA, 19 nt, Artificial Sequence
  Synthetic Oligonucleotide
auguauguuacuucuuaga

SEQ ID NO: 13806 - RNA, 19 nt, Artificial Sequence
  Synthetic Oligonucleotide
cuaggaaccuuuuagaaag

SEQ ID NO: 13807 - RNA, 19 nt, Artificial Sequence
  Synthetic Oligonucleotide
guguucaagauguccucga

SEQ ID NO: 13808 - RNA, 19 nt, Artificial Sequence
  Synthetic Oligonucleotide
cccggcuaauuuguaucaa

SEQ ID NO: 13809 - RNA, 19 nt, Artificial Sequence
  Synthetic Oligonucleotide
aaagggugucguucuuuuc

SEQ ID NO: 13810 - RNA, 19 nt, Artificial Sequence
  Synthetic Oligonucleotide
aaccuuuuagaaagaaaug

SEQ ID NO: 13811 - RNA, 19 nt, Artificial Sequence
  Synthetic Oligonucleotide
ucauugcuuuugacuuuuc

SEQ ID NO: 13812 - RNA, 19 nt, Artificial Sequence
  Synthetic Oligonucleotide
aucaaauggcugagaagac

SEQ ID NO: 13813 - RNA, 19 nt, Artificial Sequence
  Synthetic Oligonucleotide
ucguucuuuuccaacaaaa

SEQ ID NO: 13814 - RNA, 19 nt, Artificial Sequence
  Synthetic Oligonucleotide
gggugucguucuuuuccaa

SEQ ID NO: 13815 - RNA, 19 nt, Artificial Sequence
  Synthetic Oligonucleotide
uuuauuaaccuguauucug

SEQ ID NO: 13816 - RNA, 19 nt, Artificial Sequence
  Synthetic Oligonucleotide
cuuaaauuguaagcucagg

SEQ ID NO: 13817 - RNA, 19 nt, Artificial Sequence
  Synthetic Oligonucleotide
uggcugagaagacugacau

SEQ ID NO: 13818 - RNA, 19 nt, Artificial Sequence
  Synthetic Oligonucleotide
uccggaauguugcugaaac

SEQ ID NO: 13819 - RNA, 19 nt, Artificial Sequence
  Synthetic Oligonucleotide
ugaauauauccaaauguuu

SEQ ID NO: 13820 - RNA, 19 nt, Artificial Sequence
  Synthetic Oligonucleotide
cacagucuguaauucccca

SEQ ID NO: 13821 - RNA, 19 nt, Artificial Sequence
  Synthetic Oligonucleotide
uuggcugcaacuguauauc

SEQ ID NO: 13822 - RNA, 19 nt, Artificial Sequence
  Synthetic Oligonucleotide
uauuaacuguuaaaaagaa

SEQ ID NO: 13823 - RNA, 19 nt, Artificial Sequence
  Synthetic Oligonucleotide
augaugaagaaacuuuggc

SEQ ID NO: 13824 - RNA, 19 nt, Artificial Sequence
  Synthetic Oligonucleotide
aacaacaugcuaaaucagu

SEQ ID NO: 13825 - RNA, 19 nt, Artificial Sequence
  Synthetic Oligonucleotide
auuggugauacuucuuuga

SEQ ID NO: 13826 - RNA, 19 nt, Artificial Sequence
  Synthetic Oligonucleotide
ugauucacaacuuugagaa

SEQ ID NO: 13827 - RNA, 19 nt, Artificial Sequence
  Synthetic Oligonucleotide
auuucauugcuuuugacuu

SEQ ID NO: 13828 - RNA, 19 nt, Artificial Sequence
  Synthetic Oligonucleotide
cauuuuccagauggaagcu

SEQ ID NO: 13829 - RNA, 19 nt, Artificial Sequence
  Synthetic Oligonucleotide
uguauucuguuuacauguc

SEQ ID NO: 13830 - RNA, 19 nt, Artificial Sequence
  Synthetic Oligonucleotide
uacuugacaaagagacacu

SEQ ID NO: 13831 - RNA, 19 nt, Artificial Sequence
  Synthetic Oligonucleotide
agguucaaaguguugguaa

SEQ ID NO: 13832 - RNA, 19 nt, Artificial Sequence
  Synthetic Oligonucleotide
aacuguuaaaaagaaaaca

SEQ ID NO: 13833 - RNA, 19 nt, Artificial Sequence
  Synthetic Oligonucleotide
caauacaaagggugucguu

SEQ ID NO: 13834 - RNA, 19 nt, Artificial Sequence
  Synthetic Oligonucleotide
uacuuuaucauuuucuccu

SEQ ID NO: 13835 - RNA, 19 nt, Artificial Sequence
  Synthetic Oligonucleotide
ucuuuaaaacagugguucu

SEQ ID NO: 13836 - RNA, 19 nt, Artificial Sequence
  Synthetic Oligonucleotide
uccaaucacaucuuuagug

SEQ ID NO: 13837 - RNA, 19 nt, Artificial Sequence
  Synthetic Oligonucleotide
cuuccaaagucuauauaug

SEQ ID NO: 13838 - RNA, 19 nt, Artificial Sequence
  Synthetic Oligonucleotide
uuuaucauuuucuccugag

SEQ ID NO: 13839 - RNA, 19 nt, Artificial Sequence
  Synthetic Oligonucleotide
uauguuacuucuuagagag

SEQ ID NO: 13840 - RNA, 19 nt, Artificial Sequence
  Synthetic Oligonucleotide
caguacuuuaucauuuucu

SEQ ID NO: 13841 - RNA, 19 nt, Artificial Sequence
  Synthetic Oligonucleotide
gaucugacagugcacaaua

SEQ ID NO: 13842 - RNA, 19 nt, Artificial Sequence
  Synthetic Oligonucleotide
ucaagauguccucgagaua

SEQ ID NO: 13843 - RNA, 19 nt, Artificial Sequence
  Synthetic Oligonucleotide
uuacuugacaaagagacac

SEQ ID NO: 13844 - RNA, 19 nt, Artificial Sequence
  Synthetic Oligonucleotide
aaugccugauucacaacuu

SEQ ID NO: 13845 - RNA, 19 nt, Artificial Sequence
  Synthetic Oligonucleotide
auuaugaacaacaugcuaa

SEQ ID NO: 13846 - RNA, 19 nt, Artificial Sequence
  Synthetic Oligonucleotide
aauuguaagcucagguuca

SEQ ID NO: 13847 - RNA, 19 nt, Artificial Sequence
  Synthetic Oligonucleotide
aagaaauggacuuucaucc

SEQ ID NO: 13848 - RNA, 19 nt, Artificial Sequence
  Synthetic Oligonucleotide
cuaaagugcuguauccuuu

SEQ ID NO: 13849 - RNA, 19 nt, Artificial Sequence
  Synthetic Oligonucleotide
ugagugggugccagaaugu

SEQ ID NO: 13850 - RNA, 19 nt, Artificial Sequence
  Synthetic Oligonucleotide
aggauguauguuacuucuu

SEQ ID NO: 13851 - RNA, 19 nt, Artificial Sequence
  Synthetic Oligonucleotide
augugaaagucaucgacaa

SEQ ID NO: 13852 - RNA, 19 nt, Artificial Sequence
  Synthetic Oligonucleotide
gaagauaucaaauggcuga

SEQ ID NO: 13853 - RNA, 19 nt, Artificial Sequence
  Synthetic Oligonucleotide
auucuguuuacaugucuuu

SEQ ID NO: 13854 - RNA, 19 nt, Artificial Sequence
  Synthetic Oligonucleotide
aacacuaaggugaaaagau

SEQ ID NO: 13855 - RNA, 19 nt, Artificial Sequence
  Synthetic Oligonucleotide
aagucuauauaugacuauu

SEQ ID NO: 13856 - RNA, 19 nt, Artificial Sequence
  Synthetic Oligonucleotide
guacuuuaucauuuucucc

SEQ ID NO: 13857 - RNA, 19 nt, Artificial Sequence
  Synthetic Oligonucleotide
ugcagcauuuuccagaugg

SEQ ID NO: 13858 - RNA, 19 nt, Artificial Sequence
  Synthetic Oligonucleotide
caucuuuagugucugaaua

SEQ ID NO: 13859 - RNA, 19 nt, Artificial Sequence
  Synthetic Oligonucleotide
gggugccagaaugugaaag

SEQ ID NO: 13860 - RNA, 19 nt, Artificial Sequence
  Synthetic Oligonucleotide
gauguauguuacuucuuag

SEQ ID NO: 13861 - RNA, 19 nt, Artificial Sequence
  Synthetic Oligonucleotide
aaauggcugagaagacuga

SEQ ID NO: 13862 - RNA, 19 nt, Artificial Sequence
  Synthetic Oligonucleotide
cacaucuuuagugucugaa

SEQ ID NO: 13863 - RNA, 19 nt, Artificial Sequence
  Synthetic Oligonucleotide
aagaaacuuuggcugauaa

SEQ ID NO: 13864 - RNA, 19 nt, Artificial Sequence
  Synthetic Oligonucleotide
caagauguccucgagauac

SEQ ID NO: 13865 - RNA, 19 nt, Artificial Sequence
  Synthetic Oligonucleotide
gucaucgacaagacauugg

SEQ ID NO: 13866 - RNA, 19 nt, Artificial Sequence
  Synthetic Oligonucleotide
aagaucugacagugcacaa

SEQ ID NO: 13867 - RNA, 19 nt, Artificial Sequence
  Synthetic Oligonucleotide
augccugauucacaacuuu

SEQ ID NO: 13868 - RNA, 19 nt, Artificial Sequence
  Synthetic Oligonucleotide
ugcugcauauguggcuaaa

SEQ ID NO: 13869 - RNA, 19 nt, Artificial Sequence
  Synthetic Oligonucleotide
uaggaaccuuuuagaaaga

SEQ ID NO: 13870 - RNA, 19 nt, Artificial Sequence
  Synthetic Oligonucleotide
gguucaaaguguugguaau

SEQ ID NO: 13871 - RNA, 19 nt, Artificial Sequence
  Synthetic Oligonucleotide
gugcuguauccuuuaguaa

SEQ ID NO: 13872 - RNA, 19 nt, Artificial Sequence
  Synthetic Oligonucleotide
ccgccacaacucaggauga

SEQ ID NO: 13873 - RNA, 19 nt, Artificial Sequence
  Synthetic Oligonucleotide
ucacaucuuuagugucuga

SEQ ID NO: 13874 - RNA, 19 nt, Artificial Sequence
  Synthetic Oligonucleotide
cagguucaaaguguuggua

SEQ ID NO: 13875 - RNA, 19 nt, Artificial Sequence
  Synthetic Oligonucleotide
ucauuuucuccugaggaaa

SEQ ID NO: 13876 - RNA, 19 nt, Artificial Sequence
  Synthetic Oligonucleotide
ucguuggcugcaacuguau

SEQ ID NO: 13877 - RNA, 19 nt, Artificial Sequence
  Synthetic Oligonucleotide
cacuucguuggcugcaacu

SEQ ID NO: 13878 - RNA, 19 nt, Artificial Sequence
  Synthetic Oligonucleotide
cuuuuauuucauugcuuuu

SEQ ID NO: 13879 - RNA, 19 nt, Artificial Sequence
  Synthetic Oligonucleotide
aauauuuucccaucuguau

SEQ ID NO: 13880 - RNA, 19 nt, Artificial Sequence
  Synthetic Oligonucleotide
ugacaucauugccaauugu

SEQ ID NO: 13881 - RNA, 19 nt, Artificial Sequence
  Synthetic Oligonucleotide
gagaaauaaagcauuuuug

SEQ ID NO: 13882 - RNA, 19 nt, Artificial Sequence
  Synthetic Oligonucleotide
acagucuguaauuccccac

SEQ ID NO: 13883 - RNA, 19 nt, Artificial Sequence
  Synthetic Oligonucleotide
gcugagaagacugacauca

SEQ ID NO: 13884 - RNA, 19 nt, Artificial Sequence
  Synthetic Oligonucleotide
uucuuuuccaacaaaauag

SEQ ID NO: 13885 - RNA, 19 nt, Artificial Sequence
  Synthetic Oligonucleotide
gccacuauugauguucugc

SEQ ID NO: 13886 - RNA, 19 nt, Artificial Sequence
  Synthetic Oligonucleotide
gaacaacaugcuaaaucag

SEQ ID NO: 13887 - RNA, 19 nt, Artificial Sequence
  Synthetic Oligonucleotide
uccuuuaguaaaauuggag

SEQ ID NO: 13888 - RNA, 19 nt, Artificial Sequence
  Synthetic Oligonucleotide
ugcuuuugacuuuucaaug

SEQ ID NO: 13889 - RNA, 19 nt, Artificial Sequence
  Synthetic Oligonucleotide
accuuuuagaaagaaaugg

SEQ ID NO: 13890 - RNA, 19 nt, Artificial Sequence
  Synthetic Oligonucleotide
ccaaucacaucuuuagugu

SEQ ID NO: 13891 - RNA, 19 nt, Artificial Sequence
  Synthetic Oligonucleotide
aauauugcagcauuuucca

SEQ ID NO: 13892 - RNA, 19 nt, Artificial Sequence
  Synthetic Oligonucleotide
guuggcugcaacuguauau

SEQ ID NO: 13893 - RNA, 19 nt, Artificial Sequence
  Synthetic Oligonucleotide
uauuacuugacaaagagac

SEQ ID NO: 13894 - RNA, 19 nt, Artificial Sequence
  Synthetic Oligonucleotide
ccaucuaucagcugggaag

SEQ ID NO: 13895 - RNA, 19 nt, Artificial Sequence
  Synthetic Oligonucleotide
cuuuagugucugaauauau

SEQ ID NO: 13896 - RNA, 19 nt, Artificial Sequence
  Synthetic Oligonucleotide
aaucacaucuuuagugucu

SEQ ID NO: 13897 - RNA, 19 nt, Artificial Sequence
  Synthetic Oligonucleotide
gcaaucccuuuuauuucau

SEQ ID NO: 13898 - RNA, 19 nt, Artificial Sequence
  Synthetic Oligonucleotide
aucuuuagugucugaauau

SEQ ID NO: 13899 - RNA, 19 nt, Artificial Sequence
  Synthetic Oligonucleotide
auuaaccuguauucuguuu

SEQ ID NO: 13900 - RNA, 19 nt, Artificial Sequence
  Synthetic Oligonucleotide
gacaucauugccaauuguu

SEQ ID NO: 13901 - RNA, 19 nt, Artificial Sequence
  Synthetic Oligonucleotide
caaagggugucguucuuuu

SEQ ID NO: 13902 - RNA, 19 nt, Artificial Sequence
  Synthetic Oligonucleotide
uguccucgagauacuaaag

SEQ ID NO: 13903 - RNA, 19 nt, Artificial Sequence
  Synthetic Oligonucleotide
uguuacuucuuagagagaa

SEQ ID NO: 13904 - RNA, 19 nt, Artificial Sequence
  Synthetic Oligonucleotide
auacaaagggugucguucu

SEQ ID NO: 13905 - RNA, 19 nt, Artificial Sequence
  Synthetic Oligonucleotide
uuaggauguauguuacuuc

SEQ ID NO: 13906 - RNA, 19 nt, Artificial Sequence
  Synthetic Oligonucleotide
uuggcugauaauauugcag

SEQ ID NO: 13907 - RNA, 19 nt, Artificial Sequence
  Synthetic Oligonucleotide
uuccaagaucugacagugc

SEQ ID NO: 13908 - RNA, 19 nt, Artificial Sequence
  Synthetic Oligonucleotide
ucaaauggcugagaagacu

SEQ ID NO: 13909 - RNA, 19 nt, Artificial Sequence
  Synthetic Oligonucleotide
acuuccaaagucuauauau

SEQ ID NO: 13910 - RNA, 19 nt, Artificial Sequence
  Synthetic Oligonucleotide
uuagagagaaauaaagcau

SEQ ID NO: 13911 - RNA, 19 nt, Artificial Sequence
  Synthetic Oligonucleotide
guuacuucuuagagagaaa

SEQ ID NO: 13912 - RNA, 19 nt, Artificial Sequence
  Synthetic Oligonucleotide
ugggugccagaaugugaaa

SEQ ID NO: 13913 - RNA, 19 nt, Artificial Sequence
  Synthetic Oligonucleotide
gcucagguucaaaguguug

SEQ ID NO: 13914 - RNA, 19 nt, Artificial Sequence
  Synthetic Oligonucleotide
agaagguagcacuggagag

SEQ ID NO: 13915 - RNA, 19 nt, Artificial Sequence
  Synthetic Oligonucleotide
acacuaaggugaaaagaua

SEQ ID NO: 13916 - RNA, 19 nt, Artificial Sequence
  Synthetic Oligonucleotide
auaauauugcagcauuuuc

SEQ ID NO: 13917 - RNA, 19 nt, Artificial Sequence
  Synthetic Oligonucleotide
aaagaaauggacuuucauc

SEQ ID NO: 13918 - RNA, 19 nt, Artificial Sequence
  Synthetic Oligonucleotide
ucuuagagagaaauaaagc

SEQ ID NO: 13919 - RNA, 19 nt, Artificial Sequence
  Synthetic Oligonucleotide
agugguucuuaaauuguaa

SEQ ID NO: 13920 - RNA, 19 nt, Artificial Sequence
  Synthetic Oligonucleotide
cuuuaucauuuucuccuga

SEQ ID NO: 13921 - RNA, 19 nt, Artificial Sequence
  Synthetic Oligonucleotide
gauacuucuuugaauguag

SEQ ID NO: 13922 - RNA, 19 nt, Artificial Sequence
  Synthetic Oligonucleotide
guucuuaaauuguaagcuc

SEQ ID NO: 13923 - RNA, 19 nt, Artificial Sequence
  Synthetic Oligonucleotide
acaugcuaaaucaguacuu

SEQ ID NO: 13924 - RNA, 19 nt, Artificial Sequence
  Synthetic Oligonucleotide
ggaauguugcugaaacaga

SEQ ID NO: 13925 - RNA, 19 nt, Artificial Sequence
  Synthetic Oligonucleotide
auuguaagcucagguucaa

SEQ ID NO: 13926 - RNA, 19 nt, Artificial Sequence
  Synthetic Oligonucleotide
agaucugucgacuucuguu

SEQ ID NO: 13927 - RNA, 19 nt, Artificial Sequence
  Synthetic Oligonucleotide
cuacaaggccauauuugug

SEQ ID NO: 13928 - RNA, 19 nt, Artificial Sequence
  Synthetic Oligonucleotide
uacaugucuuuaaaacagu

SEQ ID NO: 13929 - RNA, 19 nt, Artificial Sequence
  Synthetic Oligonucleotide
guaauuccccacuucaaua

SEQ ID NO: 13930 - RNA, 19 nt, Artificial Sequence
  Synthetic Oligonucleotide
gucuggaugaugugcguaa

SEQ ID NO: 13931 - RNA, 19 nt, Artificial Sequence
  Synthetic Oligonucleotide
uggagguagcaaacacuaa

SEQ ID NO: 13932 - RNA, 19 nt, Artificial Sequence
  Synthetic Oligonucleotide
uucuuagagagaaauaaag

SEQ ID NO: 13933 - RNA, 19 nt, Artificial Sequence
  Synthetic Oligonucleotide
auguuuuaggauguauguu

SEQ ID NO: 13934 - RNA, 19 nt, Artificial Sequence
  Synthetic Oligonucleotide
auguccucgagauacuaaa

SEQ ID NO: 13935 - RNA, 19 nt, Artificial Sequence
  Synthetic Oligonucleotide
gccugauucacaacuuuga

SEQ ID NO: 13936 - RNA, 19 nt, Artificial Sequence
  Synthetic Oligonucleotide
uucuguuuacaugucuuua

SEQ ID NO: 13937 - RNA, 19 nt, Artificial Sequence
  Synthetic Oligonucleotide
aagauaucaaauggcugag

SEQ ID NO: 13938 - RNA, 19 nt, Artificial Sequence
  Synthetic Oligonucleotide
uuuggcugauaauauugca

SEQ ID NO: 13939 - RNA, 19 nt, Artificial Sequence
  Synthetic Oligonucleotide
uccagauggaagcuguauc

SEQ ID NO: 13940 - RNA, 19 nt, Artificial Sequence
  Synthetic Oligonucleotide
acuucguuggcugcaacug

SEQ ID NO: 13941 - RNA, 19 nt, Artificial Sequence
  Synthetic Oligonucleotide
gaagguagcacuggagaga

SEQ ID NO: 13942 - RNA, 19 nt, Artificial Sequence
  Synthetic Oligonucleotide
aauguugcugaaacagauc

SEQ ID NO: 13943 - RNA, 19 nt, Artificial Sequence
  Synthetic Oligonucleotide
cguuggcugcaacuguaua

SEQ ID NO: 13944 - RNA, 19 nt, Artificial Sequence
  Synthetic Oligonucleotide
uuagaaagaaauggacuuu

SEQ ID NO: 13945 - RNA, 19 nt, Artificial Sequence
  Synthetic Oligonucleotide
agugcacaauauuuuccca

SEQ ID NO: 13946 - RNA, 19 nt, Artificial Sequence
  Synthetic Oligonucleotide
cagugcacaauauuuuccc

SEQ ID NO: 13947 - RNA, 19 nt, Artificial Sequence
  Synthetic Oligonucleotide
gauucacaacuuugagaag

SEQ ID NO: 13948 - RNA, 19 nt, Artificial Sequence
  Synthetic Oligonucleotide
gaugcuccggaauguugcu

SEQ ID NO: 13949 - RNA, 19 nt, Artificial Sequence
  Synthetic Oligonucleotide
cuucaauacaaaggguguc

SEQ ID NO: 13950 - RNA, 19 nt, Artificial Sequence
  Synthetic Oligonucleotide
ugcaacuguauaucuacaa

SEQ ID NO: 13951 - RNA, 19 nt, Artificial Sequence
  Synthetic Oligonucleotide
uuugaauguagauuuccaa

SEQ ID NO: 13952 - RNA, 19 nt, Artificial Sequence
  Synthetic Oligonucleotide
ggauguauguuacuucuua

SEQ ID NO: 13953 - RNA, 19 nt, Artificial Sequence
  Synthetic Oligonucleotide
aauguuuuaggauguaugu

SEQ ID NO: 13954 - RNA, 19 nt, Artificial Sequence
  Synthetic Oligonucleotide
gaugaugugcguaacagau

SEQ ID NO: 13955 - RNA, 19 nt, Artificial Sequence
  Synthetic Oligonucleotide
uuaguaaaauuggagguag

SEQ ID NO: 13956 - RNA, 19 nt, Artificial Sequence
  Synthetic Oligonucleotide
agguguucaagauguccuc

SEQ ID NO: 13957 - RNA, 19 nt, Artificial Sequence
  Synthetic Oligonucleotide
uuacuucuuagagagaaau

SEQ ID NO: 13958 - RNA, 19 nt, Artificial Sequence
  Synthetic Oligonucleotide
ugacagugcacaauauuuu

SEQ ID NO: 13959 - RNA, 19 nt, Artificial Sequence
  Synthetic Oligonucleotide
aagguguucaagauguccu

SEQ ID NO: 13960 - RNA, 19 nt, Artificial Sequence
  Synthetic Oligonucleotide
auguuacuucuuagagaga

SEQ ID NO: 13961 - RNA, 19 nt, Artificial Sequence
  Synthetic Oligonucleotide
aauacaaagggugucguuc

SEQ ID NO: 13962 - RNA, 19 nt, Artificial Sequence
  Synthetic Oligonucleotide
acaugucuuuaaaacagug

SEQ ID NO: 13963 - RNA, 19 nt, Artificial Sequence
  Synthetic Oligonucleotide
gcagagggugaccacaguc

SEQ ID NO: 13964 - RNA, 19 nt, Artificial Sequence
  Synthetic Oligonucleotide
ccaaggaugcuccggaaug

SEQ ID NO: 13965 - RNA, 19 nt, Artificial Sequence
  Synthetic Oligonucleotide
agagagaaauaaagcauuu

SEQ ID NO: 13966 - RNA, 19 nt, Artificial Sequence
  Synthetic Oligonucleotide
ucuuugaauguagauuucc

SEQ ID NO: 13967 - RNA, 19 nt, Artificial Sequence
  Synthetic Oligonucleotide
cuguuuacaugucuuuaaa

SEQ ID NO: 13968 - RNA, 19 nt, Artificial Sequence
  Synthetic Oligonucleotide
aauuggagguagcaaacac

SEQ ID NO: 13969 - RNA, 19 nt, Artificial Sequence
  Synthetic Oligonucleotide
cuaaagcaauagacccauc

SEQ ID NO: 13970 - RNA, 19 nt, Artificial Sequence
  Synthetic Oligonucleotide
caacaugcuaaaucaguac

SEQ ID NO: 13971 - RNA, 19 nt, Artificial Sequence
  Synthetic Oligonucleotide
uacuucuuugaauguagau

SEQ ID NO: 13972 - RNA, 19 nt, Artificial Sequence
  Synthetic Oligonucleotide
ugccaauuguugcaaaggg

SEQ ID NO: 13973 - RNA, 19 nt, Artificial Sequence
  Synthetic Oligonucleotide
ggcuaaagugcuguauccu

SEQ ID NO: 13974 - RNA, 19 nt, Artificial Sequence
  Synthetic Oligonucleotide
guauuacuugacaaagaga

SEQ ID NO: 13975 - RNA, 19 nt, Artificial Sequence
  Synthetic Oligonucleotide
gguucuuaaauuguaagcu

SEQ ID NO: 13976 - RNA, 19 nt, Artificial Sequence
  Synthetic Oligonucleotide
ugaaacagaucugucgacu

SEQ ID NO: 13977 - RNA, 19 nt, Artificial Sequence
  Synthetic Oligonucleotide
gauaauauugcagcauuuu

SEQ ID NO: 13978 - RNA, 19 nt, Artificial Sequence
  Synthetic Oligonucleotide
cugauucacaacuuugaga

SEQ ID NO: 13979 - RNA, 19 nt, Artificial Sequence
  Synthetic Oligonucleotide
cugcauauguggcuaaagc

SEQ ID NO: 13980 - RNA, 19 nt, Artificial Sequence
  Synthetic Oligonucleotide
aagggugucguucuuuucc

SEQ ID NO: 13981 - RNA, 19 nt, Artificial Sequence
  Synthetic Oligonucleotide
aaccgucuggaugaugugc

SEQ ID NO: 13982 - RNA, 19 nt, Artificial Sequence
  Synthetic Oligonucleotide
ccuaggaaccuuuuagaaa

SEQ ID NO: 13983 - RNA, 19 nt, Artificial Sequence
  Synthetic Oligonucleotide
cagccacuauugauguucu

SEQ ID NO: 13984 - RNA, 19 nt, Artificial Sequence
  Synthetic Oligonucleotide
uucaauacaaagggugucg

SEQ ID NO: 13985 - RNA, 19 nt, Artificial Sequence
  Synthetic Oligonucleotide
cuucuuugaauguagauuu

SEQ ID NO: 13986 - RNA, 19 nt, Artificial Sequence
  Synthetic Oligonucleotide
cuucguuggcugcaacugu

SEQ ID NO: 13987 - RNA, 19 nt, Artificial Sequence
  Synthetic Oligonucleotide
uagcaauaaccugugaaaa

SEQ ID NO: 13988 - RNA, 19 nt, Artificial Sequence
  Synthetic Oligonucleotide
aaagucuauauaugacuau

SEQ ID NO: 13989 - RNA, 19 nt, Artificial Sequence
  Synthetic Oligonucleotide
aucauuuucuccugaggaa

SEQ ID NO: 13990 - RNA, 19 nt, Artificial Sequence
  Synthetic Oligonucleotide
ugcauauguggcuaaagca

SEQ ID NO: 13991 - RNA, 19 nt, Artificial Sequence
  Synthetic Oligonucleotide
gacgacaguggacuugcug

SEQ ID NO: 13992 - RNA, 19 nt, Artificial Sequence
  Synthetic Oligonucleotide
guuuccaagaucugacagu

SEQ ID NO: 13993 - RNA, 19 nt, Artificial Sequence
  Synthetic Oligonucleotide
aaaugaugaagaaacuuug

SEQ ID NO: 13994 - RNA, 19 nt, Artificial Sequence
  Synthetic Oligonucleotide
cagagggugaccacagucu

SEQ ID NO: 13995 - RNA, 19 nt, Artificial Sequence
  Synthetic Oligonucleotide
agagaaauaaagcauuuuu

SEQ ID NO: 13996 - RNA, 19 nt, Artificial Sequence
  Synthetic Oligonucleotide
uugaaugggaucuuggugu

SEQ ID NO: 13997 - RNA, 19 nt, Artificial Sequence
  Synthetic Oligonucleotide
cuguaauuccccacuucaa

SEQ ID NO: 13998 - RNA, 19 nt, Artificial Sequence
  Synthetic Oligonucleotide
ugcuguauccuuuaguaaa

SEQ ID NO: 13999 - RNA, 19 nt, Artificial Sequence
  Synthetic Oligonucleotide
gagaagguagcacuggaga

SEQ ID NO: 14000 - RNA, 19 nt, Artificial Sequence
  Synthetic Oligonucleotide
ccagccacuauugauguuc

SEQ ID NO: 14001 - RNA, 19 nt, Artificial Sequence
  Synthetic Oligonucleotide
cugacagugcacaauauuu

SEQ ID NO: 14002 - RNA, 19 nt, Artificial Sequence
  Synthetic Oligonucleotide
uguccuaggaaccuuuuag

SEQ ID NO: 14003 - RNA, 19 nt, Artificial Sequence
  Synthetic Oligonucleotide
ugaaugggaucuugguguc

SEQ ID NO: 14004 - RNA, 19 nt, Artificial Sequence
  Synthetic Oligonucleotide
agagggugaccacagucug

SEQ ID NO: 14005 - RNA, 19 nt, Artificial Sequence
  Synthetic Oligonucleotide
agaucugacagugcacaau

SEQ ID NO: 14006 - RNA, 19 nt, Artificial Sequence
  Synthetic Oligonucleotide
guacuuccaaagucuauau

SEQ ID NO: 14007 - RNA, 19 nt, Artificial Sequence
  Synthetic Oligonucleotide
uuuagaaagaaauggacuu

SEQ ID NO: 14008 - RNA, 19 nt, Artificial Sequence
  Synthetic Oligonucleotide
gagugggugccagaaugug

SEQ ID NO: 14009 - RNA, 19 nt, Artificial Sequence
  Synthetic Oligonucleotide
cugaggaaaauuuuggaga

SEQ ID NO: 14010 - RNA, 19 nt, Artificial Sequence
  Synthetic Oligonucleotide
uggggugccagccacuauu

SEQ ID NO: 14011 - RNA, 19 nt, Artificial Sequence
  Synthetic Oligonucleotide
ccccggcuaauuuguauca

SEQ ID NO: 14012 - RNA, 19 nt, Artificial Sequence
  Synthetic Oligonucleotide
ugcagagggugaccacagu

SEQ ID NO: 14013 - RNA, 19 nt, Artificial Sequence
  Synthetic Oligonucleotide
acaaggccauauuugugac

SEQ ID NO: 14014 - RNA, 19 nt, Artificial Sequence
  Synthetic Oligonucleotide
gucuuuaaaacagugguuc

SEQ ID NO: 14015 - RNA, 19 nt, Artificial Sequence
  Synthetic Oligonucleotide
uccucgagauacuaaagga

SEQ ID NO: 14016 - RNA, 19 nt, Artificial Sequence
  Synthetic Oligonucleotide
aaagcaauagacccaucua

SEQ ID NO: 14017 - RNA, 19 nt, Artificial Sequence
  Synthetic Oligonucleotide
gcauuuuccagauggaagc

SEQ ID NO: 14018 - RNA, 19 nt, Artificial Sequence
  Synthetic Oligonucleotide
caugcuaaaucaguacuuc

SEQ ID NO: 14019 - RNA, 19 nt, Artificial Sequence
  Synthetic Oligonucleotide
ccuuuuagaaagaaaugga

SEQ ID NO: 14020 - RNA, 19 nt, Artificial Sequence
  Synthetic Oligonucleotide
aguacuuuaucauuuucuc

SEQ ID NO: 14021 - RNA, 19 nt, Artificial Sequence
  Synthetic Oligonucleotide
cuaaaucaguacuuccaaa

SEQ ID NO: 14022 - RNA, 19 nt, Artificial Sequence
  Synthetic Oligonucleotide
aacagaucugucgacuucu

SEQ ID NO: 14023 - RNA, 19 nt, Artificial Sequence
  Synthetic Oligonucleotide
aagacauuggugaggaaaa

SEQ ID NO: 14024 - RNA, 19 nt, Artificial Sequence
  Synthetic Oligonucleotide
uuuccaacaaaauagcaau

SEQ ID NO: 14025 - RNA, 19 nt, Artificial Sequence
  Synthetic Oligonucleotide
aaacagaucugucgacuuc

SEQ ID NO: 14026 - RNA, 19 nt, Artificial Sequence
  Synthetic Oligonucleotide
caacuguauaucuacaagg

SEQ ID NO: 14027 - RNA, 19 nt, Artificial Sequence
  Synthetic Oligonucleotide
ccugauucacaacuuugag

SEQ ID NO: 14028 - RNA, 19 nt, Artificial Sequence
  Synthetic Oligonucleotide
gaaacuuuggcugauaaua

SEQ ID NO: 14029 - RNA, 19 nt, Artificial Sequence
  Synthetic Oligonucleotide
uuccaaucacaucuuuagu

SEQ ID NO: 14030 - RNA, 19 nt, Artificial Sequence
  Synthetic Oligonucleotide
augcuccggaauguugcug

SEQ ID NO: 14031 - RNA, 19 nt, Artificial Sequence
  Synthetic Oligonucleotide
uguaauuccccacuucaau

SEQ ID NO: 14032 - RNA, 19 nt, Artificial Sequence
  Synthetic Oligonucleotide
gaaccuuuuagaaagaaau

SEQ ID NO: 14033 - RNA, 19 nt, Artificial Sequence
  Synthetic Oligonucleotide
gguguucaagauguccucg

SEQ ID NO: 14034 - RNA, 19 nt, Artificial Sequence
  Synthetic Oligonucleotide
uaauuccccacuucaauac

SEQ ID NO: 14035 - RNA, 19 nt, Artificial Sequence
  Synthetic Oligonucleotide
uggcugcaacuguauaucu

SEQ ID NO: 14036 - RNA, 19 nt, Artificial Sequence
  Synthetic Oligonucleotide
augucuuuaaaacaguggu

SEQ ID NO: 14037 - RNA, 19 nt, Artificial Sequence
  Synthetic Oligonucleotide
ggacagagggucagcaugc

SEQ ID NO: 14038 - RNA, 19 nt, Artificial Sequence
  Synthetic Oligonucleotide
aagauguccucgagauacu

SEQ ID NO: 14039 - RNA, 19 nt, Artificial Sequence
  Synthetic Oligonucleotide
uggcgguaauuggugauac

SEQ ID NO: 14040 - RNA, 19 nt, Artificial Sequence
  Synthetic Oligonucleotide
cuucuuagagagaaauaaa

SEQ ID NO: 14041 - RNA, 19 nt, Artificial Sequence
  Synthetic Oligonucleotide
guaaaauuggagguagcaa

SEQ ID NO: 14042 - RNA, 19 nt, Artificial Sequence
  Synthetic Oligonucleotide
ugucuuuaaaacagugguu

SEQ ID NO: 14043 - RNA, 19 nt, Artificial Sequence
  Synthetic Oligonucleotide
uaggauguauguuacuucu

SEQ ID NO: 14044 - RNA, 19 nt, Artificial Sequence
  Synthetic Oligonucleotide
cuguauccuuuaguaaaau

SEQ ID NO: 14045 - RNA, 19 nt, Artificial Sequence
  Synthetic Oligonucleotide
cagcauuuuccagauggaa

SEQ ID NO: 14046 - RNA, 19 nt, Artificial Sequence
  Synthetic Oligonucleotide
ucacaacuuugagaaggua

SEQ ID NO: 14047 - RNA, 19 nt, Artificial Sequence
  Synthetic Oligonucleotide
guucuuuuccaacaaaaua

SEQ ID NO: 14048 - RNA, 19 nt, Artificial Sequence
  Synthetic Oligonucleotide
cugagugggugccagaaug

SEQ ID NO: 14049 - RNA, 19 nt, Artificial Sequence
  Synthetic Oligonucleotide
uaucaaauggcugagaaga

SEQ ID NO: 14050 - RNA, 19 nt, Artificial Sequence
  Synthetic Oligonucleotide
ugccgccacaacucaggau

SEQ ID NO: 14051 - RNA, 19 nt, Artificial Sequence
  Synthetic Oligonucleotide
aaggaugcuccggaauguu

SEQ ID NO: 14052 - RNA, 19 nt, Artificial Sequence
  Synthetic Oligonucleotide
ggagguagcaaacacuaag

SEQ ID NO: 14053 - RNA, 19 nt, Artificial Sequence
  Synthetic Oligonucleotide
ccacagucuguaauucccc

SEQ ID NO: 14054 - RNA, 19 nt, Artificial Sequence
  Synthetic Oligonucleotide
gaauguugcugaaacagau

SEQ ID NO: 14055 - RNA, 19 nt, Artificial Sequence
  Synthetic Oligonucleotide
gcuaaaucaguacuuccaa

SEQ ID NO: 14056 - RNA, 19 nt, Artificial Sequence
  Synthetic Oligonucleotide
gcaacuguauaucuacaag

SEQ ID NO: 14057 - RNA, 19 nt, Artificial Sequence
  Synthetic Oligonucleotide
aacaugcuaaaucaguacu

SEQ ID NO: 14058 - RNA, 19 nt, Artificial Sequence
  Synthetic Oligonucleotide
agauaucaaauggcugaga

SEQ ID NO: 14059 - RNA, 19 nt, Artificial Sequence
  Synthetic Oligonucleotide
uacuucuuagagagaaaua

SEQ ID NO: 14060 - RNA, 19 nt, Artificial Sequence
  Synthetic Oligonucleotide
accgucuggaugaugugcg

SEQ ID NO: 14061 - RNA, 19 nt, Artificial Sequence
  Synthetic Oligonucleotide
uugccaauuguugcaaagg

SEQ ID NO: 14062 - RNA, 19 nt, Artificial Sequence
  Synthetic Oligonucleotide
uacaaagggugucguucuu

SEQ ID NO: 14063 - RNA, 19 nt, Artificial Sequence
  Synthetic Oligonucleotide
agucaucgacaagacauug

SEQ ID NO: 14064 - RNA, 19 nt, Artificial Sequence
  Synthetic Oligonucleotide
acuuuggcugauaauauug

SEQ ID NO: 14065 - RNA, 19 nt, Artificial Sequence
  Synthetic Oligonucleotide
gacuugcugcauauguggc

SEQ ID NO: 14066 - RNA, 19 nt, Artificial Sequence
  Synthetic Oligonucleotide
ucuuuuccaacaaaauagc

SEQ ID NO: 14067 - RNA, 19 nt, Artificial Sequence
  Synthetic Oligonucleotide
cccacuucaauacaaaggg

SEQ ID NO: 14068 - RNA, 19 nt, Artificial Sequence
  Synthetic Oligonucleotide
uauauccaaauguuuuagg

SEQ ID NO: 14069 - RNA, 19 nt, Artificial Sequence
  Synthetic Oligonucleotide
caucuaucagcugggaaga

SEQ ID NO: 14070 - RNA, 19 nt, Artificial Sequence
  Synthetic Oligonucleotide
acgacaguggacuugcugc

SEQ ID NO: 14071 - RNA, 19 nt, Artificial Sequence
  Synthetic Oligonucleotide
guguccuaggaaccuuuua

SEQ ID NO: 14072 - RNA, 19 nt, Artificial Sequence
  Synthetic Oligonucleotide
gaccacagucuguaauucc

SEQ ID NO: 14073 - RNA, 19 nt, Artificial Sequence
  Synthetic Oligonucleotide
caaccgucuggaugaugug

SEQ ID NO: 14074 - RNA, 19 nt, Artificial Sequence
  Synthetic Oligonucleotide
ggcugcaacuguauaucua

SEQ ID NO: 14075 - RNA, 19 nt, Artificial Sequence
  Synthetic Oligonucleotide
uccaaggaugcuccggaau

SEQ ID NO: 14076 - RNA, 19 nt, Artificial Sequence
  Synthetic Oligonucleotide
caaggaugcuccggaaugu

SEQ ID NO: 14077 - RNA, 19 nt, Artificial Sequence
  Synthetic Oligonucleotide
auguugcugaaacagaucu

SEQ ID NO: 14078 - RNA, 19 nt, Artificial Sequence
  Synthetic Oligonucleotide
caaagggcauuuugagagg

SEQ ID NO: 14079 - RNA, 19 nt, Artificial Sequence
  Synthetic Oligonucleotide
gcuaaagcaauagacccau

SEQ ID NO: 14080 - RNA, 19 nt, Artificial Sequence
  Synthetic Oligonucleotide
uucaagauguccucgagau

SEQ ID NO: 14081 - RNA, 19 nt, Artificial Sequence
  Synthetic Oligonucleotide
gugaccacagucuguaauu

SEQ ID NO: 14082 - RNA, 19 nt, Artificial Sequence
  Synthetic Oligonucleotide
gaaagucaucgacaagaca

SEQ ID NO: 14083 - RNA, 19 nt, Artificial Sequence
  Synthetic Oligonucleotide
ugggaagauaucaaauggc

SEQ ID NO: 14084 - RNA, 19 nt, Artificial Sequence
  Synthetic Oligonucleotide
cuccugaggaaaauuuugg

SEQ ID NO: 14085 - RNA, 19 nt, Artificial Sequence
  Synthetic Oligonucleotide
uugauguucugccagaaau

SEQ ID NO: 14086 - RNA, 19 nt, Artificial Sequence
  Synthetic Oligonucleotide
ugccagccacuauugaugu

SEQ ID NO: 14087 - RNA, 19 nt, Artificial Sequence
  Synthetic Oligonucleotide
acaaagggugucguucuuu

SEQ ID NO: 14088 - RNA, 19 nt, Artificial Sequence
  Synthetic Oligonucleotide
caucgacaagacauuggug

SEQ ID NO: 14089 - RNA, 19 nt, Artificial Sequence
  Synthetic Oligonucleotide
ggaaaggcacugauguucu

SEQ ID NO: 14090 - RNA, 19 nt, Artificial Sequence
  Synthetic Oligonucleotide
agggugaccacagucugua

SEQ ID NO: 14091 - RNA, 19 nt, Artificial Sequence
  Synthetic Oligonucleotide
gccgccacaacucaggaug

SEQ ID NO: 14092 - RNA, 19 nt, Artificial Sequence
  Synthetic Oligonucleotide
guggcgguaauuggugaua

SEQ ID NO: 14093 - RNA, 19 nt, Artificial Sequence
  Synthetic Oligonucleotide
auugcuuuugacuuuucaa

SEQ ID NO: 14094 - RNA, 19 nt, Artificial Sequence
  Synthetic Oligonucleotide
caauggguguccuaggaac

SEQ ID NO: 14095 - RNA, 19 nt, Artificial Sequence
  Synthetic Oligonucleotide
auuggagguagcaaacacu

SEQ ID NO: 14096 - RNA, 19 nt, Artificial Sequence
  Synthetic Oligonucleotide
gcugaaacagaucugucga

SEQ ID NO: 14097 - RNA, 19 nt, Artificial Sequence
  Synthetic Oligonucleotide
uacaaggccauauuuguga

SEQ ID NO: 14098 - RNA, 19 nt, Artificial Sequence
  Synthetic Oligonucleotide
auugcagcauuuuccagau

SEQ ID NO: 14099 - RNA, 19 nt, Artificial Sequence
  Synthetic Oligonucleotide
ugcuaaaucaguacuucca

SEQ ID NO: 14100 - RNA, 19 nt, Artificial Sequence
  Synthetic Oligonucleotide
cagugguucuuaaauugua

SEQ ID NO: 14101 - RNA, 19 nt, Artificial Sequence
  Synthetic Oligonucleotide
cauugcuuuugacuuuuca

SEQ ID NO: 14102 - RNA, 19 nt, Artificial Sequence
  Synthetic Oligonucleotide
gagagaaauaaagcauuuu

SEQ ID NO: 14103 - RNA, 19 nt, Artificial Sequence
  Synthetic Oligonucleotide
auguagauuuccaaucaca

SEQ ID NO: 14104 - RNA, 19 nt, Artificial Sequence
  Synthetic Oligonucleotide
uuccagauggaagcuguau

SEQ ID NO: 14105 - RNA, 19 nt, Artificial Sequence
  Synthetic Oligonucleotide
caauuguugcaaagggcau

SEQ ID NO: 14106 - RNA, 19 nt, Artificial Sequence
  Synthetic Oligonucleotide
aucuacaaggaccgagaag

SEQ ID NO: 14107 - RNA, 19 nt, Artificial Sequence
  Synthetic Oligonucleotide
uuugagaagguagcacugg

SEQ ID NO: 14108 - RNA, 19 nt, Artificial Sequence
  Synthetic Oligonucleotide
uuggagguagcaaacacua

SEQ ID NO: 14109 - RNA, 19 nt, Artificial Sequence
  Synthetic Oligonucleotide
acaaggaccgagaagucac

SEQ ID NO: 14110 - RNA, 19 nt, Artificial Sequence
  Synthetic Oligonucleotide
ggcuacaaggccauauuug

SEQ ID NO: 14111 - RNA, 19 nt, Artificial Sequence
  Synthetic Oligonucleotide
ccaguacuuuaucauuuuc

SEQ ID NO: 14112 - RNA, 19 nt, Artificial Sequence
  Synthetic Oligonucleotide
uagauuuccaaucacaucu

SEQ ID NO: 14113 - RNA, 19 nt, Artificial Sequence
  Synthetic Oligonucleotide
uuuaggauguauguuacuu

SEQ ID NO: 14114 - RNA, 19 nt, Artificial Sequence
  Synthetic Oligonucleotide
acuuuaucauuuucuccug

SEQ ID NO: 14115 - RNA, 19 nt, Artificial Sequence
  Synthetic Oligonucleotide
cgucuggaugaugugcgua

SEQ ID NO: 14116 - RNA, 19 nt, Artificial Sequence
  Synthetic Oligonucleotide
acuguauaucuacaaggac

SEQ ID NO: 14117 - RNA, 19 nt, Artificial Sequence
  Synthetic Oligonucleotide
caaaugaugaagaaacuuu

SEQ ID NO: 14118 - RNA, 19 nt, Artificial Sequence
  Synthetic Oligonucleotide
cagaucugucgacuucugu

SEQ ID NO: 14119 - RNA, 19 nt, Artificial Sequence
  Synthetic Oligonucleotide
aagguagcacuggagagaa

SEQ ID NO: 14120 - RNA, 19 nt, Artificial Sequence
  Synthetic Oligonucleotide
gaaagaaauggacuuucau

SEQ ID NO: 14121 - RNA, 19 nt, Artificial Sequence
  Synthetic Oligonucleotide
gaaaggcacugauguucug

SEQ ID NO: 14122 - RNA, 19 nt, Artificial Sequence
  Synthetic Oligonucleotide
aauggcugagaagacugac

SEQ ID NO: 14123 - RNA, 19 nt, Artificial Sequence
  Synthetic Oligonucleotide
gccagccacuauugauguu

SEQ ID NO: 14124 - RNA, 19 nt, Artificial Sequence
  Synthetic Oligonucleotide
cugcaacuguauaucuaca

SEQ ID NO: 14125 - RNA, 19 nt, Artificial Sequence
  Synthetic Oligonucleotide
agaaagguguucaagaugu

SEQ ID NO: 14126 - RNA, 19 nt, Artificial Sequence
  Synthetic Oligonucleotide
uguuuuaggauguauguua

SEQ ID NO: 14127 - RNA, 19 nt, Artificial Sequence
  Synthetic Oligonucleotide
uggguguccuaggaaccuu

SEQ ID NO: 14128 - RNA, 19 nt, Artificial Sequence
  Synthetic Oligonucleotide
gaaacagaucugucgacuu

SEQ ID NO: 14129 - RNA, 19 nt, Artificial Sequence
  Synthetic Oligonucleotide
ggaagauaucaaauggcug

SEQ ID NO: 14130 - RNA, 19 nt, Artificial Sequence
  Synthetic Oligonucleotide
auauugcagcauuuuccag

SEQ ID NO: 14131 - RNA, 19 nt, Artificial Sequence
  Synthetic Oligonucleotide
ucaauacaaagggugucgu

SEQ ID NO: 14132 - RNA, 19 nt, Artificial Sequence
  Synthetic Oligonucleotide
ugacuuuucaauggguguc

SEQ ID NO: 14133 - RNA, 19 nt, Artificial Sequence
  Synthetic Oligonucleotide
uugcuuuugacuuuucaau

SEQ ID NO: 14134 - RNA, 19 nt, Artificial Sequence
  Synthetic Oligonucleotide
uguugcugaaacagaucug

SEQ ID NO: 14135 - RNA, 19 nt, Artificial Sequence
  Synthetic Oligonucleotide
cggaauguugcugaaacag

SEQ ID NO: 14136 - RNA, 19 nt, Artificial Sequence
  Synthetic Oligonucleotide
aggcuaaagugcuguaucc

SEQ ID NO: 14137 - RNA, 19 nt, Artificial Sequence
  Synthetic Oligonucleotide
caggcuaaagugcuguauc

SEQ ID NO: 14138 - RNA, 19 nt, Artificial Sequence
  Synthetic Oligonucleotide
uugagaagguagcacugga

SEQ ID NO: 14139 - RNA, 19 nt, Artificial Sequence
  Synthetic Oligonucleotide
guggcuaaagcaauagacc

SEQ ID NO: 14140 - RNA, 19 nt, Artificial Sequence
  Synthetic Oligonucleotide
ccaauuguugcaaagggca

SEQ ID NO: 14141 - RNA, 19 nt, Artificial Sequence
  Synthetic Oligonucleotide
uuuaguaaaauuggaggua

SEQ ID NO: 14142 - RNA, 19 nt, Artificial Sequence
  Synthetic Oligonucleotide
uguauaucuacaaggaccg

SEQ ID NO: 14143 - RNA, 19 nt, Artificial Sequence
  Synthetic Oligonucleotide
cauauguggcuaaagcaau

SEQ ID NO: 14144 - RNA, 19 nt, Artificial Sequence
  Synthetic Oligonucleotide
aaauuggagguagcaaaca

SEQ ID NO: 14145 - RNA, 19 nt, Artificial Sequence
  Synthetic Oligonucleotide
guauaucuacaaggaccga

SEQ ID NO: 14146 - RNA, 19 nt, Artificial Sequence
  Synthetic Oligonucleotide
caguggacuugcugcauau

SEQ ID NO: 14147 - RNA, 19 nt, Artificial Sequence
  Synthetic Oligonucleotide
uguauccuuuaguaaaauu

SEQ ID NO: 14148 - RNA, 19 nt, Artificial Sequence
  Synthetic Oligonucleotide
auuacuugacaaagagaca

SEQ ID NO: 14149 - RNA, 19 nt, Artificial Sequence
  Synthetic Oligonucleotide
uugacuuuucaaugggugu

SEQ ID NO: 14150 - RNA, 19 nt, Artificial Sequence
  Synthetic Oligonucleotide
uuuuagaaagaaauggacu

SEQ ID NO: 14151 - RNA, 19 nt, Artificial Sequence
  Synthetic Oligonucleotide
ggaugcuccggaauguugc

SEQ ID NO: 14152 - RNA, 19 nt, Artificial Sequence
  Synthetic Oligonucleotide
uagaaagaaauggacuuuc

SEQ ID NO: 14153 - RNA, 19 nt, Artificial Sequence
  Synthetic Oligonucleotide
uguuuacaugucuuuaaaa

SEQ ID NO: 14154 - RNA, 19 nt, Artificial Sequence
  Synthetic Oligonucleotide
aaugaugaagaaacuuugg

SEQ ID NO: 14155 - RNA, 19 nt, Artificial Sequence
  Synthetic Oligonucleotide
agacgacaguggacuugcu

SEQ ID NO: 14156 - RNA, 19 nt, Artificial Sequence
  Synthetic Oligonucleotide
acagaucugucgacuucug

SEQ ID NO: 14157 - RNA, 19 nt, Artificial Sequence
  Synthetic Oligonucleotide
auauguggcuaaagcaaua

SEQ ID NO: 14158 - RNA, 19 nt, Artificial Sequence
  Synthetic Oligonucleotide
ugcggaaaggcacugaugu

SEQ ID NO: 14159 - RNA, 19 nt, Artificial Sequence
  Synthetic Oligonucleotide
gcugcauauguggcuaaag

SEQ ID NO: 14160 - RNA, 19 nt, Artificial Sequence
  Synthetic Oligonucleotide
uggagacgacaguggacuu

SEQ ID NO: 14161 - RNA, 19 nt, Artificial Sequence
  Synthetic Oligonucleotide
gugcagagggugaccacag

SEQ ID NO: 14162 - RNA, 19 nt, Artificial Sequence
  Synthetic Oligonucleotide
ucuuuagugucugaauaua

SEQ ID NO: 14163 - RNA, 19 nt, Artificial Sequence
  Synthetic Oligonucleotide
guucaagauguccucgaga

SEQ ID NO: 14164 - RNA, 19 nt, Artificial Sequence
  Synthetic Oligonucleotide
aguaaaauuggagguagca

SEQ ID NO: 14165 - RNA, 19 nt, Artificial Sequence
  Synthetic Oligonucleotide
auucacaacuuugagaagg

SEQ ID NO: 14166 - RNA, 19 nt, Artificial Sequence
  Synthetic Oligonucleotide
gauaucaaauggcugagaa

SEQ ID NO: 14167 - RNA, 19 nt, Artificial Sequence
  Synthetic Oligonucleotide
ggagaaagguguucaagau

SEQ ID NO: 14168 - RNA, 19 nt, Artificial Sequence
  Synthetic Oligonucleotide
guagauuuccaaucacauc

SEQ ID NO: 14169 - RNA, 19 nt, Artificial Sequence
  Synthetic Oligonucleotide
cuuugaauguagauuucca

SEQ ID NO: 14170 - RNA, 19 nt, Artificial Sequence
  Synthetic Oligonucleotide
uauugcagcauuuuccaga

SEQ ID NO: 14171 - RNA, 19 nt, Artificial Sequence
  Synthetic Oligonucleotide
ccccacuucaauacaaagg

SEQ ID NO: 14172 - RNA, 19 nt, Artificial Sequence
  Synthetic Oligonucleotide
acuucuuugaauguagauu

SEQ ID NO: 14173 - RNA, 19 nt, Artificial Sequence
  Synthetic Oligonucleotide
acuugcugcauauguggcu

SEQ ID NO: 14174 - RNA, 19 nt, Artificial Sequence
  Synthetic Oligonucleotide
aauggguguccuaggaacc

SEQ ID NO: 14175 - RNA, 19 nt, Artificial Sequence
  Synthetic Oligonucleotide
ggcuaaagcaauagaccca

SEQ ID NO: 14176 - RNA, 19 nt, Artificial Sequence
  Synthetic Oligonucleotide
ucgagauacuaaaggaaga

SEQ ID NO: 14177 - RNA, 19 nt, Artificial Sequence
  Synthetic Oligonucleotide
ugugcggaaaggcacugau

SEQ ID NO: 14178 - RNA, 19 nt, Artificial Sequence
  Synthetic Oligonucleotide
uuuuaggauguauguuacu

SEQ ID NO: 14179 - RNA, 19 nt, Artificial Sequence
  Synthetic Oligonucleotide
gaggaaaauuuuggagacg

SEQ ID NO: 14180 - RNA, 19 nt, Artificial Sequence
  Synthetic Oligonucleotide
ccuuuaguaaaauuggagg

SEQ ID NO: 14181 - RNA, 19 nt, Artificial Sequence
  Synthetic Oligonucleotide
aggacagagggucagcaug

SEQ ID NO: 14182 - RNA, 19 nt, Artificial Sequence
  Synthetic Oligonucleotide
ucugucgacuucuguuuua

SEQ ID NO: 14183 - RNA, 19 nt, Artificial Sequence
  Synthetic Oligonucleotide
guuuuaggauguauguuac

SEQ ID NO: 14184 - RNA, 19 nt, Artificial Sequence
  Synthetic Oligonucleotide
guagcacuggagagaauug

SEQ ID NO: 14185 - RNA, 19 nt, Artificial Sequence
  Synthetic Oligonucleotide
aaaauuggagguagcaaac

SEQ ID NO: 14186 - RNA, 19 nt, Artificial Sequence
  Synthetic Oligonucleotide
auggcugagaagacugaca

SEQ ID NO: 14187 - RNA, 19 nt, Artificial Sequence
  Synthetic Oligonucleotide
uuuccaaucacaucuuuag

SEQ ID NO: 14188 - RNA, 19 nt, Artificial Sequence
  Synthetic Oligonucleotide
acuucaauacaaagggugu

SEQ ID NO: 14189 - RNA, 19 nt, Artificial Sequence
  Synthetic Oligonucleotide
cuguauaucuacaaggacc

SEQ ID NO: 14190 - RNA, 19 nt, Artificial Sequence
  Synthetic Oligonucleotide
ggacuugcugcauaugugg

SEQ ID NO: 14191 - RNA, 19 nt, Artificial Sequence
  Synthetic Oligonucleotide
aaacuuuggcugauaauau

SEQ ID NO: 14192 - RNA, 19 nt, Artificial Sequence
  Synthetic Oligonucleotide
aaauuuuggagacgacagu

SEQ ID NO: 14193 - RNA, 19 nt, Artificial Sequence
  Synthetic Oligonucleotide
aucugucgacuucuguuuu

SEQ ID NO: 14194 - RNA, 19 nt, Artificial Sequence
  Synthetic Oligonucleotide
gucuggggcaaaugaugaa

SEQ ID NO: 14195 - RNA, 19 nt, Artificial Sequence
  Synthetic Oligonucleotide
uucuccugaggaaaauuuu

SEQ ID NO: 14196 - RNA, 19 nt, Artificial Sequence
  Synthetic Oligonucleotide
uguggcuaaagcaauagac

SEQ ID NO: 14197 - RNA, 19 nt, Artificial Sequence
  Synthetic Oligonucleotide
gacagagggucagcaugcc

SEQ ID NO: 14198 - RNA, 19 nt, Artificial Sequence
  Synthetic Oligonucleotide
cuuuugacuuuucaauggg

SEQ ID NO: 14199 - RNA, 19 nt, Artificial Sequence
  Synthetic Oligonucleotide
cggaaaggcacugauguuc

SEQ ID NO: 14200 - RNA, 19 nt, Artificial Sequence
  Synthetic Oligonucleotide
accacagucuguaauuccc

SEQ ID NO: 14201 - RNA, 19 nt, Artificial Sequence
  Synthetic Oligonucleotide
cuuuggcugauaauauugc

SEQ ID NO: 14202 - RNA, 19 nt, Artificial Sequence
  Synthetic Oligonucleotide
aggaaccuuuuagaaagaa

SEQ ID NO: 14203 - RNA, 19 nt, Artificial Sequence
  Synthetic Oligonucleotide
guccucgagauacuaaagg

SEQ ID NO: 14204 - RNA, 19 nt, Artificial Sequence
  Synthetic Oligonucleotide
cgagauacuaaaggaagaa

SEQ ID NO: 14205 - RNA, 19 nt, Artificial Sequence
  Synthetic Oligonucleotide
cccaucuaucagcugggaa

SEQ ID NO: 14206 - RNA, 19 nt, Artificial Sequence
  Synthetic Oligonucleotide
ugcugaaacagaucugucg

SEQ ID NO: 14207 - RNA, 19 nt, Artificial Sequence
  Synthetic Oligonucleotide
cuuuaguaaaauuggaggu

SEQ ID NO: 14208 - RNA, 19 nt, Artificial Sequence
  Synthetic Oligonucleotide
agagacacugugcagaggg

SEQ ID NO: 14209 - RNA, 19 nt, Artificial Sequence
  Synthetic Oligonucleotide
auccuuuaguaaaauugga

SEQ ID NO: 14210 - RNA, 19 nt, Artificial Sequence
  Synthetic Oligonucleotide
gcagcauuuuccagaugga

SEQ ID NO: 14211 - RNA, 19 nt, Artificial Sequence
  Synthetic Oligonucleotide
aacuguauaucuacaagga

SEQ ID NO: 14212 - RNA, 19 nt, Artificial Sequence
  Synthetic Oligonucleotide
gcuuuugacuuuucaaugg

SEQ ID NO: 14213 - RNA, 19 nt, Artificial Sequence
  Synthetic Oligonucleotide
gcuaaagugcuguauccuu

SEQ ID NO: 14214 - RNA, 19 nt, Artificial Sequence
  Synthetic Oligonucleotide
guccuaggaaccuuuuaga

SEQ ID NO: 14215 - RNA, 19 nt, Artificial Sequence
  Synthetic Oligonucleotide
aaagagacacugugcagag

SEQ ID NO: 14216 - RNA, 19 nt, Artificial Sequence
  Synthetic Oligonucleotide
auggguguccuaggaaccu

SEQ ID NO: 14217 - RNA, 19 nt, Artificial Sequence
  Synthetic Oligonucleotide
agacccaucuaucagcugg

SEQ ID NO: 14218 - RNA, 19 nt, Artificial Sequence
  Synthetic Oligonucleotide
auuuucuccugaggaaaau

SEQ ID NO: 14219 - RNA, 19 nt, Artificial Sequence
  Synthetic Oligonucleotide
uaaagcaauagacccaucu

SEQ ID NO: 14220 - RNA, 19 nt, Artificial Sequence
  Synthetic Oligonucleotide
auggggugccagccacuau

SEQ ID NO: 14221 - RNA, 19 nt, Artificial Sequence
  Synthetic Oligonucleotide
cugaaacagaucugucgac

SEQ ID NO: 14222 - RNA, 19 nt, Artificial Sequence
  Synthetic Oligonucleotide
uccccacuucaauacaaag

SEQ ID NO: 14223 - RNA, 19 nt, Artificial Sequence
  Synthetic Oligonucleotide
guuuacaugucuuuaaaac

SEQ ID NO: 14224 - RNA, 19 nt, Artificial Sequence
  Synthetic Oligonucleotide
ugagaagguagcacuggag

SEQ ID NO: 14225 - RNA, 19 nt, Artificial Sequence
  Synthetic Oligonucleotide
cuguauccaaggaugcucc

SEQ ID NO: 14226 - RNA, 19 nt, Artificial Sequence
  Synthetic Oligonucleotide
ugcaaagggcauuuugaga

SEQ ID NO: 14227 - RNA, 19 nt, Artificial Sequence
  Synthetic Oligonucleotide
uggguggcgguaauuggug

SEQ ID NO: 14228 - RNA, 19 nt, Artificial Sequence
  Synthetic Oligonucleotide
gccaauuguugcaaagggc

SEQ ID NO: 14229 - RNA, 19 nt, Artificial Sequence
  Synthetic Oligonucleotide
aauguagauuuccaaucac

SEQ ID NO: 14230 - RNA, 19 nt, Artificial Sequence
  Synthetic Oligonucleotide
ugacaaagagacacugugc

SEQ ID NO: 14231 - RNA, 19 nt, Artificial Sequence
  Synthetic Oligonucleotide
uugcugaaacagaucuguc

SEQ ID NO: 14232 - RNA, 19 nt, Artificial Sequence
  Synthetic Oligonucleotide
uccugaggaaaauuuugga

SEQ ID NO: 14233 - RNA, 19 nt, Artificial Sequence
  Synthetic Oligonucleotide
cuuagagagaaauaaagca

SEQ ID NO: 14234 - RNA, 19 nt, Artificial Sequence
  Synthetic Oligonucleotide
uggcuaaagcaauagaccc

SEQ ID NO: 14235 - RNA, 19 nt, Artificial Sequence
  Synthetic Oligonucleotide
uccuaggaaccuuuuagaa

SEQ ID NO: 14236 - RNA, 19 nt, Artificial Sequence
  Synthetic Oligonucleotide
acaucauugccaauuguug

SEQ ID NO: 14237 - RNA, 19 nt, Artificial Sequence
  Synthetic Oligonucleotide
ccagauggaagcuguaucc

SEQ ID NO: 14238 - RNA, 19 nt, Artificial Sequence
  Synthetic Oligonucleotide
cugugcagagggugaccac

SEQ ID NO: 14239 - RNA, 19 nt, Artificial Sequence
  Synthetic Oligonucleotide
agauggaagcuguauccaa

SEQ ID NO: 14240 - RNA, 19 nt, Artificial Sequence
  Synthetic Oligonucleotide
caucauugccaauuguugc

SEQ ID NO: 14241 - RNA, 19 nt, Artificial Sequence
  Synthetic Oligonucleotide
aaagucaucgacaagacau

SEQ ID NO: 14242 - RNA, 19 nt, Artificial Sequence
  Synthetic Oligonucleotide
auguggcuaaagcaauaga

SEQ ID NO: 14243 - RNA, 19 nt, Artificial Sequence
  Synthetic Oligonucleotide
ccgucuggaugaugugcgu

SEQ ID NO: 14244 - RNA, 19 nt, Artificial Sequence
  Synthetic Oligonucleotide
ugcuccggaauguugcuga

SEQ ID NO: 14245 - RNA, 19 nt, Artificial Sequence
  Synthetic Oligonucleotide
uuuuccaacaaaauagcaa

SEQ ID NO: 14246 - RNA, 19 nt, Artificial Sequence
  Synthetic Oligonucleotide
cuuuuagaaagaaauggac

SEQ ID NO: 14247 - RNA, 19 nt, Artificial Sequence
  Synthetic Oligonucleotide
gcggaaaggcacugauguu

SEQ ID NO: 14248 - RNA, 19 nt, Artificial Sequence
  Synthetic Oligonucleotide
gaaagguguucaagauguc

SEQ ID NO: 14249 - RNA, 19 nt, Artificial Sequence
  Synthetic Oligonucleotide
gagaaagguguucaagaug

SEQ ID NO: 14250 - RNA, 19 nt, Artificial Sequence
  Synthetic Oligonucleotide
auuguugcaaagggcauuu

SEQ ID NO: 14251 - RNA, 19 nt, Artificial Sequence
  Synthetic Oligonucleotide
cguucuuuuccaacaaaau

SEQ ID NO: 14252 - RNA, 19 nt, Artificial Sequence
  Synthetic Oligonucleotide
ccacuucaauacaaagggu

SEQ ID NO: 14253 - RNA, 19 nt, Artificial Sequence
  Synthetic Oligonucleotide
uuuccaagaucugacagug

SEQ ID NO: 14254 - RNA, 19 nt, Artificial Sequence
  Synthetic Oligonucleotide
cacuucaauacaaagggug

SEQ ID NO: 14255 - RNA, 19 nt, Artificial Sequence
  Synthetic Oligonucleotide
acuuugagaagguagcacu

SEQ ID NO: 14256 - RNA, 19 nt, Artificial Sequence
  Synthetic Oligonucleotide
cugccgccacaacucagga

SEQ ID NO: 14257 - RNA, 19 nt, Artificial Sequence
  Synthetic Oligonucleotide
guugcugaaacagaucugu

SEQ ID NO: 14258 - RNA, 19 nt, Artificial Sequence
  Synthetic Oligonucleotide
ggaaccuuuuagaaagaaa

SEQ ID NO: 14259 - RNA, 19 nt, Artificial Sequence
  Synthetic Oligonucleotide
caugucuuuaaaacagugg

SEQ ID NO: 14260 - RNA, 19 nt, Artificial Sequence
  Synthetic Oligonucleotide
auugauguucugccagaaa

SEQ ID NO: 14261 - RNA, 19 nt, Artificial Sequence
  Synthetic Oligonucleotide
ggggugccagccacuauug

SEQ ID NO: 14262 - RNA, 19 nt, Artificial Sequence
  Synthetic Oligonucleotide
gagacgacaguggacuugc

SEQ ID NO: 14263 - RNA, 19 nt, Artificial Sequence
  Synthetic Oligonucleotide
uguugcaaagggcauuuug

SEQ ID NO: 14264 - RNA, 19 nt, Artificial Sequence
  Synthetic Oligonucleotide
aaggaccgagaagucacca

SEQ ID NO: 14265 - RNA, 19 nt, Artificial Sequence
  Synthetic Oligonucleotide
cuccggaauguugcugaaa

SEQ ID NO: 14266 - RNA, 19 nt, Artificial Sequence
  Synthetic Oligonucleotide
caggucuggggcaaaugau

SEQ ID NO: 14267 - RNA, 19 nt, Artificial Sequence
  Synthetic Oligonucleotide
gugccagccacuauugaug

SEQ ID NO: 14268 - RNA, 19 nt, Artificial Sequence
  Synthetic Oligonucleotide
gugcggaaaggcacugaug

SEQ ID NO: 14269 - RNA, 19 nt, Artificial Sequence
  Synthetic Oligonucleotide
cuugcugcauauguggcua

SEQ ID NO: 14270 - RNA, 19 nt, Artificial Sequence
  Synthetic Oligonucleotide
cugggaagauaucaaaugg

SEQ ID NO: 14271 - RNA, 19 nt, Artificial Sequence
  Synthetic Oligonucleotide
gguguccuaggaaccuuuu

SEQ ID NO: 14272 - RNA, 19 nt, Artificial Sequence
  Synthetic Oligonucleotide
cucgagauacuaaaggaag

SEQ ID NO: 14273 - RNA, 19 nt, Artificial Sequence
  Synthetic Oligonucleotide
ugggcuacaaggccauauu

SEQ ID NO: 14274 - RNA, 19 nt, Artificial Sequence
  Synthetic Oligonucleotide
uucacaacuuugagaaggu

SEQ ID NO: 14275 - RNA, 19 nt, Artificial Sequence
  Synthetic Oligonucleotide
gcacuucguuggcugcaac

SEQ ID NO: 14276 - RNA, 19 nt, Artificial Sequence
  Synthetic Oligonucleotide
ugauguucugccagaaauu

SEQ ID NO: 14277 - RNA, 19 nt, Artificial Sequence
  Synthetic Oligonucleotide
uguagauuuccaaucacau

SEQ ID NO: 14278 - RNA, 19 nt, Artificial Sequence
  Synthetic Oligonucleotide
uggacuugcugcauaugug

SEQ ID NO: 14279 - RNA, 19 nt, Artificial Sequence
  Synthetic Oligonucleotide
agcauuuuccagauggaag

SEQ ID NO: 14280 - RNA, 19 nt, Artificial Sequence
  Synthetic Oligonucleotide
agacauuggugaggaaaaa

SEQ ID NO: 14281 - RNA, 19 nt, Artificial Sequence
  Synthetic Oligonucleotide
ggugccagccacuauugau

SEQ ID NO: 14282 - RNA, 19 nt, Artificial Sequence
  Synthetic Oligonucleotide
uacaaggaccgagaaguca

SEQ ID NO: 14283 - RNA, 19 nt, Artificial Sequence
  Synthetic Oligonucleotide
caaggccauauuugugaca

SEQ ID NO: 14284 - RNA, 19 nt, Artificial Sequence
  Synthetic Oligonucleotide
gguggcgguaauuggugau

SEQ ID NO: 14285 - RNA, 19 nt, Artificial Sequence
  Synthetic Oligonucleotide
uguauccaaggaugcuccg

SEQ ID NO: 14286 - RNA, 19 nt, Artificial Sequence
  Synthetic Oligonucleotide
cagauggaagcuguaucca

SEQ ID NO: 14287 - RNA, 19 nt, Artificial Sequence
  Synthetic Oligonucleotide
ucaauggguguccuaggaa

SEQ ID NO: 14288 - RNA, 19 nt, Artificial Sequence
  Synthetic Oligonucleotide
acaacuuugagaagguagc

SEQ ID NO: 14289 - RNA, 19 nt, Artificial Sequence
  Synthetic Oligonucleotide
uuacaugucuuuaaaacag

SEQ ID NO: 14290 - RNA, 19 nt, Artificial Sequence
  Synthetic Oligonucleotide
aauggguggcgguaauugg

SEQ ID NO: 14291 - RNA, 19 nt, Artificial Sequence
  Synthetic Oligonucleotide
uuuucaauggguguccuag

SEQ ID NO: 14292 - RNA, 19 nt, Artificial Sequence
  Synthetic Oligonucleotide
cuugacaaagagacacugu

SEQ ID NO: 14293 - RNA, 19 nt, Artificial Sequence
  Synthetic Oligonucleotide
agaaagaaauggacuuuca

SEQ ID NO: 14294 - RNA, 19 nt, Artificial Sequence
  Synthetic Oligonucleotide
gcuguauccuuuaguaaaa

SEQ ID NO: 14295 - RNA, 19 nt, Artificial Sequence
  Synthetic Oligonucleotide
cuaucagcugggaagauau

SEQ ID NO: 14296 - RNA, 19 nt, Artificial Sequence
  Synthetic Oligonucleotide
gggugccagccacuauuga

SEQ ID NO: 14297 - RNA, 19 nt, Artificial Sequence
  Synthetic Oligonucleotide
uacaggucuggggcaaaug

SEQ ID NO: 14298 - RNA, 19 nt, Artificial Sequence
  Synthetic Oligonucleotide
gugggugccagaaugugaa

SEQ ID NO: 14299 - RNA, 19 nt, Artificial Sequence
  Synthetic Oligonucleotide
gauggaagcuguauccaag

SEQ ID NO: 14300 - RNA, 19 nt, Artificial Sequence
  Synthetic Oligonucleotide
ucugagugggugccagaau

SEQ ID NO: 14301 - RNA, 19 nt, Artificial Sequence
  Synthetic Oligonucleotide
auuuuccagauggaagcug

SEQ ID NO: 14302 - RNA, 19 nt, Artificial Sequence
  Synthetic Oligonucleotide
auaucuacaaggaccgaga

SEQ ID NO: 14303 - RNA, 19 nt, Artificial Sequence
  Synthetic Oligonucleotide
ugaggaaaauuuuggagac

SEQ ID NO: 14304 - RNA, 19 nt, Artificial Sequence
  Synthetic Oligonucleotide
gagggugaccacagucugu

SEQ ID NO: 14305 - RNA, 19 nt, Artificial Sequence
  Synthetic Oligonucleotide
uugacaaagagacacugug

SEQ ID NO: 14306 - RNA, 19 nt, Artificial Sequence
  Synthetic Oligonucleotide
aaagguguucaagaugucc

SEQ ID NO: 14307 - RNA, 19 nt, Artificial Sequence
  Synthetic Oligonucleotide
uagcacuggagagaauugg

SEQ ID NO: 14308 - RNA, 19 nt, Artificial Sequence
  Synthetic Oligonucleotide
uuuacaugucuuuaaaaca

SEQ ID NO: 14309 - RNA, 19 nt, Artificial Sequence
  Synthetic Oligonucleotide
ccgagaagucaccaagaag

SEQ ID NO: 14310 - RNA, 19 nt, Artificial Sequence
  Synthetic Oligonucleotide
agucuauauaugacuauua

SEQ ID NO: 14311 - RNA, 19 nt, Artificial Sequence
  Synthetic Oligonucleotide
gucuauauaugacuauuac

SEQ ID NO: 14312 - RNA, 19 nt, Artificial Sequence
  Synthetic Oligonucleotide
gcaaagggcauuuugagag

SEQ ID NO: 14313 - RNA, 19 nt, Artificial Sequence
  Synthetic Oligonucleotide
gggaagauaucaaauggcu

SEQ ID NO: 14314 - RNA, 19 nt, Artificial Sequence
  Synthetic Oligonucleotide
acagauucaaacugccgcc

SEQ ID NO: 14315 - RNA, 19 nt, Artificial Sequence
  Synthetic Oligonucleotide
aggaugcuccggaauguug

SEQ ID NO: 14316 - RNA, 19 nt, Artificial Sequence
  Synthetic Oligonucleotide
ccugaggaaaauuuuggag

SEQ ID NO: 14317 - RNA, 19 nt, Artificial Sequence
  Synthetic Oligonucleotide
cuacaaggaccgagaaguc

SEQ ID NO: 14318 - RNA, 19 nt, Artificial Sequence
  Synthetic Oligonucleotide
gcaaaugaugaagaaacuu

SEQ ID NO: 14319 - RNA, 19 nt, Artificial Sequence
  Synthetic Oligonucleotide
aaaggcacugauguucuga

SEQ ID NO: 14320 - RNA, 19 nt, Artificial Sequence
  Synthetic Oligonucleotide
ggcaaaugaugaagaaacu

SEQ ID NO: 14321 - RNA, 19 nt, Artificial Sequence
  Synthetic Oligonucleotide
auggguggcgguaauuggu

SEQ ID NO: 14322 - RNA, 19 nt, Artificial Sequence
  Synthetic Oligonucleotide
ucuggggcaaaugaugaag

SEQ ID NO: 14323 - RNA, 19 nt, Artificial Sequence
  Synthetic Oligonucleotide
gaauggguggcgguaauug

SEQ ID NO: 14324 - RNA, 19 nt, Artificial Sequence
  Synthetic Oligonucleotide
cugucgacuucuguuuuag

SEQ ID NO: 14325 - RNA, 19 nt, Artificial Sequence
  Synthetic Oligonucleotide
gcugcaacuguauaucuac

SEQ ID NO: 14326 - RNA, 19 nt, Artificial Sequence
  Synthetic Oligonucleotide
gcauauguggcuaaagcaa

SEQ ID NO: 14327 - RNA, 19 nt, Artificial Sequence
  Synthetic Oligonucleotide
aacugccgccacaacucag

SEQ ID NO: 14328 - RNA, 19 nt, Artificial Sequence
  Synthetic Oligonucleotide
ucuaucagcugggaagaua

SEQ ID NO: 14329 - RNA, 19 nt, Artificial Sequence
  Synthetic Oligonucleotide
uaaaauuggagguagcaaa

SEQ ID NO: 14330 - RNA, 19 nt, Artificial Sequence
  Synthetic Oligonucleotide
gacauuggugaggaaaaau

SEQ ID NO: 14331 - RNA, 19 nt, Artificial Sequence
  Synthetic Oligonucleotide
acaaagagacacugugcag

SEQ ID NO: 14332 - RNA, 19 nt, Artificial Sequence
  Synthetic Oligonucleotide
ugaccacagucuguaauuc

SEQ ID NO: 14333 - RNA, 19 nt, Artificial Sequence
  Synthetic Oligonucleotide
gggagaaagguguucaaga

SEQ ID NO: 14334 - RNA, 19 nt, Artificial Sequence
  Synthetic Oligonucleotide
cuuugagaagguagcacug

SEQ ID NO: 14335 - RNA, 19 nt, Artificial Sequence
  Synthetic Oligonucleotide
aaagggcauuuugagaggu

SEQ ID NO: 14336 - RNA, 19 nt, Artificial Sequence
  Synthetic Oligonucleotide
uuacaggucuggggcaaau

SEQ ID NO: 14337 - RNA, 19 nt, Artificial Sequence
  Synthetic Oligonucleotide
cauuuucuccugaggaaaa

SEQ ID NO: 14338 - RNA, 19 nt, Artificial Sequence
  Synthetic Oligonucleotide
guauccuuuaguaaaauug

SEQ ID NO: 14339 - RNA, 19 nt, Artificial Sequence
  Synthetic Oligonucleotide
aucuaucagcugggaagau

SEQ ID NO: 14340 - RNA, 19 nt, Artificial Sequence
  Synthetic Oligonucleotide
cugggccaccuccucaauu

SEQ ID NO: 14341 - RNA, 19 nt, Artificial Sequence
  Synthetic Oligonucleotide
ucuacaaggaccgagaagu

SEQ ID NO: 14342 - RNA, 19 nt, Artificial Sequence
  Synthetic Oligonucleotide
ggaauggguggcgguaauu

SEQ ID NO: 14343 - RNA, 19 nt, Artificial Sequence
  Synthetic Oligonucleotide
gggcuacaaggccauauuu

SEQ ID NO: 14344 - RNA, 19 nt, Artificial Sequence
  Synthetic Oligonucleotide
uuuucuccugaggaaaauu

SEQ ID NO: 14345 - RNA, 19 nt, Artificial Sequence
  Synthetic Oligonucleotide
aggaccgagaagucaccaa

SEQ ID NO: 14346 - RNA, 19 nt, Artificial Sequence
  Synthetic Oligonucleotide
ggguguccuaggaaccuuu

SEQ ID NO: 14347 - RNA, 19 nt, Artificial Sequence
  Synthetic Oligonucleotide
accgagaagucaccaagaa

SEQ ID NO: 14348 - RNA, 19 nt, Artificial Sequence
  Synthetic Oligonucleotide
ccucgagauacuaaaggaa

SEQ ID NO: 14349 - RNA, 19 nt, Artificial Sequence
  Synthetic Oligonucleotide
ggagacgacaguggacuug

SEQ ID NO: 14350 - RNA, 19 nt, Artificial Sequence
  Synthetic Oligonucleotide
uagacccaucuaucagcug

SEQ ID NO: 14351 - RNA, 19 nt, Artificial Sequence
  Synthetic Oligonucleotide
cucugagugggugccagaa

SEQ ID NO: 14352 - RNA, 19 nt, Artificial Sequence
  Synthetic Oligonucleotide
gacaaagagacacugugca

SEQ ID NO: 14353 - RNA, 19 nt, Artificial Sequence
  Synthetic Oligonucleotide
uugcugcauauguggcuaa

SEQ ID NO: 14354 - RNA, 19 nt, Artificial Sequence
  Synthetic Oligonucleotide
acuucuuagagagaaauaa

SEQ ID NO: 14355 - RNA, 19 nt, Artificial Sequence
  Synthetic Oligonucleotide
uucaauggguguccuagga

SEQ ID NO: 14356 - RNA, 19 nt, Artificial Sequence
  Synthetic Oligonucleotide
acccaucuaucagcuggga

SEQ ID NO: 14357 - RNA, 19 nt, Artificial Sequence
  Synthetic Oligonucleotide
ucuauauaugacuauuaca

SEQ ID NO: 14358 - RNA, 19 nt, Artificial Sequence
  Synthetic Oligonucleotide
acaggucuggggcaaauga

SEQ ID NO: 14359 - RNA, 19 nt, Artificial Sequence
  Synthetic Oligonucleotide
caauagacccaucuaucag

SEQ ID NO: 14360 - RNA, 19 nt, Artificial Sequence
  Synthetic Oligonucleotide
auugccaauuguugcaaag

SEQ ID NO: 14361 - RNA, 19 nt, Artificial Sequence
  Synthetic Oligonucleotide
agauguccucgagauacua

SEQ ID NO: 14362 - RNA, 19 nt, Artificial Sequence
  Synthetic Oligonucleotide
uuguugcaaagggcauuuu

SEQ ID NO: 14363 - RNA, 19 nt, Artificial Sequence
  Synthetic Oligonucleotide
gugugcggaaaggcacuga

SEQ ID NO: 14364 - RNA, 19 nt, Artificial Sequence
  Synthetic Oligonucleotide
gcuccggaauguugcugaa

SEQ ID NO: 14365 - RNA, 19 nt, Artificial Sequence
  Synthetic Oligonucleotide
agguagcacuggagagaau

SEQ ID NO: 14366 - RNA, 19 nt, Artificial Sequence
  Synthetic Oligonucleotide
cgacaguggacuugcugca

SEQ ID NO: 14367 - RNA, 19 nt, Artificial Sequence
  Synthetic Oligonucleotide
acaguggacuugcugcaua

SEQ ID NO: 14368 - RNA, 19 nt, Artificial Sequence
  Synthetic Oligonucleotide
ugaggcacuucguuggcug

SEQ ID NO: 14369 - RNA, 19 nt, Artificial Sequence
  Synthetic Oligonucleotide
auuuccaaucacaucuuua

SEQ ID NO: 14370 - RNA, 19 nt, Artificial Sequence
  Synthetic Oligonucleotide
aauuuuggagacgacagug

SEQ ID NO: 14371 - RNA, 19 nt, Artificial Sequence
  Synthetic Oligonucleotide
uauccuuuaguaaaauugg

SEQ ID NO: 14372 - RNA, 19 nt, Artificial Sequence
  Synthetic Oligonucleotide
cuugaaugggaucuuggug

SEQ ID NO: 14373 - RNA, 19 nt, Artificial Sequence
  Synthetic Oligonucleotide
gcacugauguucugaaagc

SEQ ID NO: 14374 - RNA, 19 nt, Artificial Sequence
  Synthetic Oligonucleotide
agcuugccacugugagagc

SEQ ID NO: 14375 - RNA, 19 nt, Artificial Sequence
  Synthetic Oligonucleotide
ggaaaauuuuggagacgac

SEQ ID NO: 14376 - RNA, 19 nt, Artificial Sequence
  Synthetic Oligonucleotide
gggugaccacagucuguaa

SEQ ID NO: 14377 - RNA, 19 nt, Artificial Sequence
  Synthetic Oligonucleotide
uaggacagagggucagcau

SEQ ID NO: 14378 - RNA, 19 nt, Artificial Sequence
  Synthetic Oligonucleotide
ggguggcgguaauugguga

SEQ ID NO: 14379 - RNA, 19 nt, Artificial Sequence
  Synthetic Oligonucleotide
gggcauuuugagaggugau

SEQ ID NO: 14380 - RNA, 19 nt, Artificial Sequence
  Synthetic Oligonucleotide
auggaagcuguauccaagg

SEQ ID NO: 14381 - RNA, 19 nt, Artificial Sequence
  Synthetic Oligonucleotide
gguagcacuggagagaauu

SEQ ID NO: 14382 - RNA, 19 nt, Artificial Sequence
  Synthetic Oligonucleotide
ggaccgagaagucaccaag

SEQ ID NO: 14383 - RNA, 19 nt, Artificial Sequence
  Synthetic Oligonucleotide
gacccaucuaucagcuggg

SEQ ID NO: 14384 - RNA, 19 nt, Artificial Sequence
  Synthetic Oligonucleotide
agggaggcuguuaaacaug

SEQ ID NO: 14385 - RNA, 19 nt, Artificial Sequence
  Synthetic Oligonucleotide
caaggaccgagaagucacc

SEQ ID NO: 14386 - RNA, 19 nt, Artificial Sequence
  Synthetic Oligonucleotide
gcugggaagauaucaaaug

SEQ ID NO: 14387 - RNA, 19 nt, Artificial Sequence
  Synthetic Oligonucleotide
uaucagcugggaagauauc

SEQ ID NO: 14388 - RNA, 19 nt, Artificial Sequence
  Synthetic Oligonucleotide
guuaaacauggcuugaaug

SEQ ID NO: 14389 - RNA, 19 nt, Artificial Sequence
  Synthetic Oligonucleotide
aggaaaauuuuggagacga

SEQ ID NO: 14390 - RNA, 19 nt, Artificial Sequence
  Synthetic Oligonucleotide
ggggagaaagguguucaag

SEQ ID NO: 14391 - RNA, 19 nt, Artificial Sequence
  Synthetic Oligonucleotide
guugcaaagggcauuuuga

SEQ ID NO: 14392 - RNA, 19 nt, Artificial Sequence
  Synthetic Oligonucleotide
aauuguugcaaagggcauu

SEQ ID NO: 14393 - RNA, 19 nt, Artificial Sequence
  Synthetic Oligonucleotide
cuuuuccaacaaaauagca

SEQ ID NO: 14394 - RNA, 19 nt, Artificial Sequence
  Synthetic Oligonucleotide
aauuccccacuucaauaca

SEQ ID NO: 14395 - RNA, 19 nt, Artificial Sequence
  Synthetic Oligonucleotide
ugacuauuacaggucuggg

SEQ ID NO: 14396 - RNA, 19 nt, Artificial Sequence
  Synthetic Oligonucleotide
agaaauuguggaggcugug

SEQ ID NO: 14397 - RNA, 19 nt, Artificial Sequence
  Synthetic Oligonucleotide
ugugcagagggugaccaca

SEQ ID NO: 14398 - RNA, 19 nt, Artificial Sequence
  Synthetic Oligonucleotide
aucauugccaauuguugca

SEQ ID NO: 14399 - RNA, 19 nt, Artificial Sequence
  Synthetic Oligonucleotide
guauccaaggaugcuccgg

SEQ ID NO: 14400 - RNA, 19 nt, Artificial Sequence
  Synthetic Oligonucleotide
gagauacuaaaggaagaau

SEQ ID NO: 14401 - RNA, 19 nt, Artificial Sequence
  Synthetic Oligonucleotide
aagagacacugugcagagg

SEQ ID NO: 14402 - RNA, 19 nt, Artificial Sequence
  Synthetic Oligonucleotide
gaaaauuuuggagacgaca

SEQ ID NO: 14403 - RNA, 19 nt, Artificial Sequence
  Synthetic Oligonucleotide
gaucugucgacuucuguuu

SEQ ID NO: 14404 - RNA, 19 nt, Artificial Sequence
  Synthetic Oligonucleotide
ggugaccacagucuguaau

SEQ ID NO: 14405 - RNA, 19 nt, Artificial Sequence
  Synthetic Oligonucleotide
cacugugcagagggugacc

SEQ ID NO: 14406 - RNA, 19 nt, Artificial Sequence
  Synthetic Oligonucleotide
uuucaauggguguccuagg

SEQ ID NO: 14407 - RNA, 19 nt, Artificial Sequence
  Synthetic Oligonucleotide
cuuuucaauggguguccua

SEQ ID NO: 14408 - RNA, 19 nt, Artificial Sequence
  Synthetic Oligonucleotide
gggugugcggaaaggcacu

SEQ ID NO: 14409 - RNA, 19 nt, Artificial Sequence
  Synthetic Oligonucleotide
uauguggcuaaagcaauag

SEQ ID NO: 14410 - RNA, 19 nt, Artificial Sequence
  Synthetic Oligonucleotide
ucgacuucuguuuuaggac

SEQ ID NO: 14411 - RNA, 19 nt, Artificial Sequence
  Synthetic Oligonucleotide
agauuuccaaucacaucuu

SEQ ID NO: 14412 - RNA, 19 nt, Artificial Sequence
  Synthetic Oligonucleotide
gauguccucgagauacuaa

SEQ ID NO: 14413 - RNA, 19 nt, Artificial Sequence
  Synthetic Oligonucleotide
uugcaaagggcauuuugag

SEQ ID NO: 14414 - RNA, 19 nt, Artificial Sequence
  Synthetic Oligonucleotide
agauacuaaaggaagaauu

SEQ ID NO: 14415 - RNA, 19 nt, Artificial Sequence
  Synthetic Oligonucleotide
ggcuugaaugggaucuugg

SEQ ID NO: 14416 - RNA, 19 nt, Artificial Sequence
  Synthetic Oligonucleotide
ucuguuuuaggacagaggg

SEQ ID NO: 14417 - RNA, 19 nt, Artificial Sequence
  Synthetic Oligonucleotide
cugggaacgggcaugaugu

SEQ ID NO: 14418 - RNA, 19 nt, Artificial Sequence
  Synthetic Oligonucleotide
uaucuacaaggaccgagaa

SEQ ID NO: 14419 - RNA, 19 nt, Artificial Sequence
  Synthetic Oligonucleotide
ucuccugaggaaaauuuug

SEQ ID NO: 14420 - RNA, 19 nt, Artificial Sequence
  Synthetic Oligonucleotide
aggcuguuaaacauggcuu

SEQ ID NO: 14421 - RNA, 19 nt, Artificial Sequence
  Synthetic Oligonucleotide
cgauggggugccagccacu

SEQ ID NO: 14422 - RNA, 19 nt, Artificial Sequence
  Synthetic Oligonucleotide
agaugggcuacaaggccau

SEQ ID NO: 14423 - RNA, 19 nt, Artificial Sequence
  Synthetic Oligonucleotide
ggcuguuaaacauggcuug

SEQ ID NO: 14424 - RNA, 19 nt, Artificial Sequence
  Synthetic Oligonucleotide
agggcauuuugagagguga

SEQ ID NO: 14425 - RNA, 19 nt, Artificial Sequence
  Synthetic Oligonucleotide
aaaauuuuggagacgacag

SEQ ID NO: 14426 - RNA, 19 nt, Artificial Sequence
  Synthetic Oligonucleotide
agugggugccagaauguga

SEQ ID NO: 14427 - RNA, 19 nt, Artificial Sequence
  Synthetic Oligonucleotide
gcaaccgucuggaugaugu

SEQ ID NO: 14428 - RNA, 19 nt, Artificial Sequence
  Synthetic Oligonucleotide
aagcaauagacccaucuau

SEQ ID NO: 14429 - RNA, 19 nt, Artificial Sequence
  Synthetic Oligonucleotide
aguggacuugcugcauaug

SEQ ID NO: 14430 - RNA, 19 nt, Artificial Sequence
  Synthetic Oligonucleotide
ucauugccaauuguugcaa

SEQ ID NO: 14431 - RNA, 19 nt, Artificial Sequence
  Synthetic Oligonucleotide
gacuauuacaggucugggg

SEQ ID NO: 14432 - RNA, 19 nt, Artificial Sequence
  Synthetic Oligonucleotide
auccaaggaugcuccggaa

SEQ ID NO: 14433 - RNA, 19 nt, Artificial Sequence
  Synthetic Oligonucleotide
ugccagaaauuguggaggc

SEQ ID NO: 14434 - RNA, 19 nt, Artificial Sequence
  Synthetic Oligonucleotide
gcuacaaggccauauuugu

SEQ ID NO: 14435 - RNA, 19 nt, Artificial Sequence
  Synthetic Oligonucleotide
uggaauggguggcgguaau

SEQ ID NO: 14436 - RNA, 19 nt, Artificial Sequence
  Synthetic Oligonucleotide
cucgauggggugccagcca

SEQ ID NO: 14437 - RNA, 19 nt, Artificial Sequence
  Synthetic Oligonucleotide
uuaaacauggcuugaaugg

SEQ ID NO: 14438 - RNA, 19 nt, Artificial Sequence
  Synthetic Oligonucleotide
uuccccacuucaauacaaa

SEQ ID NO: 14439 - RNA, 19 nt, Artificial Sequence
  Synthetic Oligonucleotide
ucuguuuacaugucuuuaa

SEQ ID NO: 14440 - RNA, 19 nt, Artificial Sequence
  Synthetic Oligonucleotide
cacugauguucugaaagcu

SEQ ID NO: 14441 - RNA, 19 nt, Artificial Sequence
  Synthetic Oligonucleotide
gcucugagugggugccaga

SEQ ID NO: 14442 - RNA, 19 nt, Artificial Sequence
  Synthetic Oligonucleotide
acuugacaaagagacacug

SEQ ID NO: 14443 - RNA, 19 nt, Artificial Sequence
  Synthetic Oligonucleotide
ugucgacuucuguuuuagg

SEQ ID NO: 14444 - RNA, 19 nt, Artificial Sequence
  Synthetic Oligonucleotide
uuggagacgacaguggacu

SEQ ID NO: 14445 - RNA, 19 nt, Artificial Sequence
  Synthetic Oligonucleotide
aagggcauuuugagaggug

SEQ ID NO: 14446 - RNA, 19 nt, Artificial Sequence
  Synthetic Oligonucleotide
cacaacuuugagaagguag

SEQ ID NO: 14447 - RNA, 19 nt, Artificial Sequence
  Synthetic Oligonucleotide
augggcuacaaggccauau

SEQ ID NO: 14448 - RNA, 19 nt, Artificial Sequence
  Synthetic Oligonucleotide
ugggccaccuccucaauug

SEQ ID NO: 14449 - RNA, 19 nt, Artificial Sequence
  Synthetic Oligonucleotide
ccguuuccaagaucugaca

SEQ ID NO: 14450 - RNA, 19 nt, Artificial Sequence
  Synthetic Oligonucleotide
ggggcaaaugaugaagaaa

SEQ ID NO: 14451 - RNA, 19 nt, Artificial Sequence
  Synthetic Oligonucleotide
gaaugggaucuuggugucg

SEQ ID NO: 14452 - RNA, 19 nt, Artificial Sequence
  Synthetic Oligonucleotide
ugcguaacagauucaaacu

SEQ ID NO: 14453 - RNA, 19 nt, Artificial Sequence
  Synthetic Oligonucleotide
gaugggcuacaaggccaua

SEQ ID NO: 14454 - RNA, 19 nt, Artificial Sequence
  Synthetic Oligonucleotide
ugggaacgggcaugauguu

SEQ ID NO: 14455 - RNA, 19 nt, Artificial Sequence
  Synthetic Oligonucleotide
uucuguuuuaggacagagg

SEQ ID NO: 14456 - RNA, 19 nt, Artificial Sequence
  Synthetic Oligonucleotide
aaacugccgccacaacuca

SEQ ID NO: 14457 - RNA, 19 nt, Artificial Sequence
  Synthetic Oligonucleotide
gagaagaugggcuacaagg

SEQ ID NO: 14458 - RNA, 19 nt, Artificial Sequence
  Synthetic Oligonucleotide
uaacagauucaaacugccg

SEQ ID NO: 14459 - RNA, 19 nt, Artificial Sequence
  Synthetic Oligonucleotide
uauccaaggaugcuccgga

SEQ ID NO: 14460 - RNA, 19 nt, Artificial Sequence
  Synthetic Oligonucleotide
uuuccagauggaagcugua

SEQ ID NO: 14461 - RNA, 19 nt, Artificial Sequence
  Synthetic Oligonucleotide
gaagcuguauccaaggaug

SEQ ID NO: 14462 - RNA, 19 nt, Artificial Sequence
  Synthetic Oligonucleotide
ucgauggggugccagccac

SEQ ID NO: 14463 - RNA, 19 nt, Artificial Sequence
  Synthetic Oligonucleotide
uuuuggagacgacagugga

SEQ ID NO: 14464 - RNA, 19 nt, Artificial Sequence
  Synthetic Oligonucleotide
uguuaaacauggcuugaau

SEQ ID NO: 14465 - RNA, 19 nt, Artificial Sequence
  Synthetic Oligonucleotide
aggcacuucguuggcugca

SEQ ID NO: 14466 - RNA, 19 nt, Artificial Sequence
  Synthetic Oligonucleotide
auggcuugaaugggaucuu

SEQ ID NO: 14467 - RNA, 19 nt, Artificial Sequence
  Synthetic Oligonucleotide
ucagcugggaagauaucaa

SEQ ID NO: 14468 - RNA, 19 nt, Artificial Sequence
  Synthetic Oligonucleotide
uuuuccagauggaagcugu

SEQ ID NO: 14469 - RNA, 19 nt, Artificial Sequence
  Synthetic Oligonucleotide
agcaauagacccaucuauc

SEQ ID NO: 14470 - RNA, 19 nt, Artificial Sequence
  Synthetic Oligonucleotide
cguuuccaagaucugacag

SEQ ID NO: 14471 - RNA, 19 nt, Artificial Sequence
  Synthetic Oligonucleotide
caacuuugagaagguagca

SEQ ID NO: 14472 - RNA, 19 nt, Artificial Sequence
  Synthetic Oligonucleotide
uugccacugugagagccug

SEQ ID NO: 14473 - RNA, 19 nt, Artificial Sequence
  Synthetic Oligonucleotide
aacauggcuugaaugggau

SEQ ID NO: 14474 - RNA, 19 nt, Artificial Sequence
  Synthetic Oligonucleotide
agcugggaagauaucaaau

SEQ ID NO: 14475 - RNA, 19 nt, Artificial Sequence
  Synthetic Oligonucleotide
gcuugaaugggaucuuggu

SEQ ID NO: 14476 - RNA, 19 nt, Artificial Sequence
  Synthetic Oligonucleotide
gcaauagacccaucuauca

SEQ ID NO: 14477 - RNA, 19 nt, Artificial Sequence
  Synthetic Oligonucleotide
uuuugacuuuucaaugggu

SEQ ID NO: 14478 - RNA, 19 nt, Artificial Sequence
  Synthetic Oligonucleotide
uacuaaaggaagaauuccg

SEQ ID NO: 14479 - RNA, 19 nt, Artificial Sequence
  Synthetic Oligonucleotide
acugccgccacaacucagg

SEQ ID NO: 14480 - RNA, 19 nt, Artificial Sequence
  Synthetic Oligonucleotide
gaugugcguaacagauuca

SEQ ID NO: 14481 - RNA, 19 nt, Artificial Sequence
  Synthetic Oligonucleotide
gggcaaaugaugaagaaac

SEQ ID NO: 14482 - RNA, 19 nt, Artificial Sequence
  Synthetic Oligonucleotide
ggaacgggcaugauguuga

SEQ ID NO: 14483 - RNA, 19 nt, Artificial Sequence
  Synthetic Oligonucleotide
uggcuugaaugggaucuug

SEQ ID NO: 14484 - RNA, 19 nt, Artificial Sequence
  Synthetic Oligonucleotide
acauuggugaggaaaaauc

SEQ ID NO: 14485 - RNA, 19 nt, Artificial Sequence
  Synthetic Oligonucleotide
gucgaaucauggggcucga

SEQ ID NO: 14486 - RNA, 19 nt, Artificial Sequence
  Synthetic Oligonucleotide
gaagaugggcuacaaggcc

SEQ ID NO: 14487 - RNA, 19 nt, Artificial Sequence
  Synthetic Oligonucleotide
augugcguaacagauucaa

SEQ ID NO: 14488 - RNA, 19 nt, Artificial Sequence
  Synthetic Oligonucleotide
aacuuugagaagguagcac

SEQ ID NO: 14489 - RNA, 19 nt, Artificial Sequence
  Synthetic Oligonucleotide
cuauuacaggucuggggca

SEQ ID NO: 14490 - RNA, 19 nt, Artificial Sequence
  Synthetic Oligonucleotide
uuugacuuuucaaugggug

SEQ ID NO: 14491 - RNA, 19 nt, Artificial Sequence
  Synthetic Oligonucleotide
gacacugugcagaggguga

SEQ ID NO: 14492 - RNA, 19 nt, Artificial Sequence
  Synthetic Oligonucleotide
cagaaauuguggaggcugu

SEQ ID NO: 14493 - RNA, 19 nt, Artificial Sequence
  Synthetic Oligonucleotide
cauugccaauuguugcaaa

SEQ ID NO: 14494 - RNA, 19 nt, Artificial Sequence
  Synthetic Oligonucleotide
ggcuguggaagggaaggug

SEQ ID NO: 14495 - RNA, 19 nt, Artificial Sequence
  Synthetic Oligonucleotide
gagcuugccacugugagag

SEQ ID NO: 14496 - RNA, 19 nt, Artificial Sequence
  Synthetic Oligonucleotide
cuguuuuaggacagagggu

SEQ ID NO: 14497 - RNA, 19 nt, Artificial Sequence
  Synthetic Oligonucleotide
uggaagggaagguggaagu

SEQ ID NO: 14498 - RNA, 19 nt, Artificial Sequence
  Synthetic Oligonucleotide
uggggcaaaugaugaagaa

SEQ ID NO: 14499 - RNA, 19 nt, Artificial Sequence
  Synthetic Oligonucleotide
caaacugccgccacaacuc

SEQ ID NO: 14500 - RNA, 19 nt, Artificial Sequence
  Synthetic Oligonucleotide
ggaagcuguauccaaggau

SEQ ID NO: 14501 - RNA, 19 nt, Artificial Sequence
  Synthetic Oligonucleotide
uuuuaggacagagggucag

SEQ ID NO: 14502 - RNA, 19 nt, Artificial Sequence
  Synthetic Oligonucleotide
guggacuugcugcauaugu

SEQ ID NO: 14503 - RNA, 19 nt, Artificial Sequence
  Synthetic Oligonucleotide
ggcucugagugggugccag

SEQ ID NO: 14504 - RNA, 19 nt, Artificial Sequence
  Synthetic Oligonucleotide
cuauauaugacuauuacag

SEQ ID NO: 14505 - RNA, 19 nt, Artificial Sequence
  Synthetic Oligonucleotide
cguaacagauucaaacugc

SEQ ID NO: 14506 - RNA, 19 nt, Artificial Sequence
  Synthetic Oligonucleotide
gauuuccaaucacaucuuu

SEQ ID NO: 14507 - RNA, 19 nt, Artificial Sequence
  Synthetic Oligonucleotide
caaagagacacugugcaga

SEQ ID NO: 14508 - RNA, 19 nt, Artificial Sequence
  Synthetic Oligonucleotide
cuguggaagggaaggugga

SEQ ID NO: 14509 - RNA, 19 nt, Artificial Sequence
  Synthetic Oligonucleotide
gaccgagaagucaccaaga

SEQ ID NO: 14510 - RNA, 19 nt, Artificial Sequence
  Synthetic Oligonucleotide
ugggcaaccgucuggauga

SEQ ID NO: 14511 - RNA, 19 nt, Artificial Sequence
  Synthetic Oligonucleotide
uggcaggcuaaagugcugu

SEQ ID NO: 14512 - RNA, 19 nt, Artificial Sequence
  Synthetic Oligonucleotide
gggaggcuguuaaacaugg

SEQ ID NO: 14513 - RNA, 19 nt, Artificial Sequence
  Synthetic Oligonucleotide
agagaauuggaaugggugg

SEQ ID NO: 14514 - RNA, 19 nt, Artificial Sequence
  Synthetic Oligonucleotide
gacuuuucaaugggugucc

SEQ ID NO: 14515 - RNA, 19 nt, Artificial Sequence
  Synthetic Oligonucleotide
augaugccagggaggcugu

SEQ ID NO: 14516 - RNA, 19 nt, Artificial Sequence
  Synthetic Oligonucleotide
cagauucaaacugccgcca

SEQ ID NO: 14517 - RNA, 19 nt, Artificial Sequence
  Synthetic Oligonucleotide
uuaggacagagggucagca

SEQ ID NO: 14518 - RNA, 19 nt, Artificial Sequence
  Synthetic Oligonucleotide
gagacacugugcagagggu

SEQ ID NO: 14519 - RNA, 19 nt, Artificial Sequence
  Synthetic Oligonucleotide
uuggugucgaaucaugggg

SEQ ID NO: 14520 - RNA, 19 nt, Artificial Sequence
  Synthetic Oligonucleotide
aauagacccaucuaucagc

SEQ ID NO: 14521 - RNA, 19 nt, Artificial Sequence
  Synthetic Oligonucleotide
acauggcuugaaugggauc

SEQ ID NO: 14522 - RNA, 19 nt, Artificial Sequence
  Synthetic Oligonucleotide
uucaaacugccgccacaac

SEQ ID NO: 14523 - RNA, 19 nt, Artificial Sequence
  Synthetic Oligonucleotide
ugaugaugccagggaggcu

SEQ ID NO: 14524 - RNA, 19 nt, Artificial Sequence
  Synthetic Oligonucleotide
uccugggccaccuccucaa

SEQ ID NO: 14525 - RNA, 19 nt, Artificial Sequence
  Synthetic Oligonucleotide
ugauguucugaaagcucug

SEQ ID NO: 14526 - RNA, 19 nt, Artificial Sequence
  Synthetic Oligonucleotide
acuauuacaggucuggggc

SEQ ID NO: 14527 - RNA, 19 nt, Artificial Sequence
  Synthetic Oligonucleotide
gauggggugccagccacua

SEQ ID NO: 14528 - RNA, 19 nt, Artificial Sequence
  Synthetic Oligonucleotide
gucgacuucuguuuuagga

SEQ ID NO: 14529 - RNA, 19 nt, Artificial Sequence
  Synthetic Oligonucleotide
agacacugugcagagggug

SEQ ID NO: 14530 - RNA, 19 nt, Artificial Sequence
  Synthetic Oligonucleotide
uuuaggacagagggucagc

SEQ ID NO: 14531 - RNA, 19 nt, Artificial Sequence
  Synthetic Oligonucleotide
guggaagggaagguggaag

SEQ ID NO: 14532 - RNA, 19 nt, Artificial Sequence
  Synthetic Oligonucleotide
aaggcacugauguucugaa

SEQ ID NO: 14533 - RNA, 19 nt, Artificial Sequence
  Synthetic Oligonucleotide
auuacaggucuggggcaaa

SEQ ID NO: 14534 - RNA, 19 nt, Artificial Sequence
  Synthetic Oligonucleotide
gagaauuggaauggguggc

SEQ ID NO: 14535 - RNA, 19 nt, Artificial Sequence
  Synthetic Oligonucleotide
uauaucuacaaggaccgag

SEQ ID NO: 14536 - RNA, 19 nt, Artificial Sequence
  Synthetic Oligonucleotide
aacagauucaaacugccgc

SEQ ID NO: 14537 - RNA, 19 nt, Artificial Sequence
  Synthetic Oligonucleotide
aggucuggggcaaaugaug

SEQ ID NO: 14538 - RNA, 19 nt, Artificial Sequence
  Synthetic Oligonucleotide
gggcaaccgucuggaugau

SEQ ID NO: 14539 - RNA, 19 nt, Artificial Sequence
  Synthetic Oligonucleotide
uauuacaggucuggggcaa

SEQ ID NO: 14540 - RNA, 19 nt, Artificial Sequence
  Synthetic Oligonucleotide
cuggggcaaaugaugaaga

SEQ ID NO: 14541 - RNA, 19 nt, Artificial Sequence
  Synthetic Oligonucleotide
agaagaugggcuacaaggc

SEQ ID NO: 14542 - RNA, 19 nt, Artificial Sequence
  Synthetic Oligonucleotide
uuuggagacgacaguggac

SEQ ID NO: 14543 - RNA, 19 nt, Artificial Sequence
  Synthetic Oligonucleotide
cauuuugagaggugaugau

SEQ ID NO: 14544 - RNA, 19 nt, Artificial Sequence
  Synthetic Oligonucleotide
cgagaagucaccaagaagc

SEQ ID NO: 14545 - RNA, 19 nt, Artificial Sequence
  Synthetic Oligonucleotide
gggaacgggcaugauguug

SEQ ID NO: 14546 - RNA, 19 nt, Artificial Sequence
  Synthetic Oligonucleotide
gaauuggaauggguggcgg

SEQ ID NO: 14547 - RNA, 19 nt, Artificial Sequence
  Synthetic Oligonucleotide
auguucugccagaaauugu

SEQ ID NO: 14548 - RNA, 19 nt, Artificial Sequence
  Synthetic Oligonucleotide
aggcuguggaagggaaggu

SEQ ID NO: 14549 - RNA, 19 nt, Artificial Sequence
  Synthetic Oligonucleotide
gagaccaaucguuuggggc

SEQ ID NO: 14550 - RNA, 19 nt, Artificial Sequence
  Synthetic Oligonucleotide
ucaaacugccgccacaacu

SEQ ID NO: 14551 - RNA, 19 nt, Artificial Sequence
  Synthetic Oligonucleotide
ggucuggggcaaaugauga

SEQ ID NO: 14552 - RNA, 19 nt, Artificial Sequence
  Synthetic Oligonucleotide
cucaauugaagaaguggcg

SEQ ID NO: 14553 - RNA, 19 nt, Artificial Sequence
  Synthetic Oligonucleotide
gcaggcuaaagugcuguau

SEQ ID NO: 14554 - RNA, 19 nt, Artificial Sequence
  Synthetic Oligonucleotide
cagcugggaagauaucaaa

SEQ ID NO: 14555 - RNA, 19 nt, Artificial Sequence
  Synthetic Oligonucleotide
aagcuguauccaaggaugc

SEQ ID NO: 14556 - RNA, 19 nt, Artificial Sequence
  Synthetic Oligonucleotide
cgagcuugccacugugaga

SEQ ID NO: 14557 - RNA, 19 nt, Artificial Sequence
  Synthetic Oligonucleotide
cccugggaacgggcaugau

SEQ ID NO: 14558 - RNA, 19 nt, Artificial Sequence
  Synthetic Oligonucleotide
uuggaauggguggcgguaa

SEQ ID NO: 14559 - RNA, 19 nt, Artificial Sequence
  Synthetic Oligonucleotide
aggugaugaugccagggag

SEQ ID NO: 14560 - RNA, 19 nt, Artificial Sequence
  Synthetic Oligonucleotide
guguuuagacaacgucauc

SEQ ID NO: 14561 - RNA, 19 nt, Artificial Sequence
  Synthetic Oligonucleotide
auuuuggagacgacagugg

SEQ ID NO: 14562 - RNA, 19 nt, Artificial Sequence
  Synthetic Oligonucleotide
ggcauuuugagaggugaug

SEQ ID NO: 14563 - RNA, 19 nt, Artificial Sequence
  Synthetic Oligonucleotide
aagaugggcuacaaggcca

SEQ ID NO: 14564 - RNA, 19 nt, Artificial Sequence
  Synthetic Oligonucleotide
gauacuaaaggaagaauuc

SEQ ID NO: 14565 - RNA, 19 nt, Artificial Sequence
  Synthetic Oligonucleotide
auuuugagaggugaugaug

SEQ ID NO: 14566 - RNA, 19 nt, Artificial Sequence
  Synthetic Oligonucleotide
aggcacugauguucugaaa

SEQ ID NO: 14567 - RNA, 19 nt, Artificial Sequence
  Synthetic Oligonucleotide
cagggaggcuguuaaacau

SEQ ID NO: 14568 - RNA, 19 nt, Artificial Sequence
  Synthetic Oligonucleotide
cuucuguuuuaggacagag

SEQ ID NO: 14569 - RNA, 19 nt, Artificial Sequence
  Synthetic Oligonucleotide
guaacagauucaaacugcc

SEQ ID NO: 14570 - RNA, 19 nt, Artificial Sequence
  Synthetic Oligonucleotide
cugccagaaauuguggagg

SEQ ID NO: 14571 - RNA, 19 nt, Artificial Sequence
  Synthetic Oligonucleotide
ggcaaccgucuggaugaug

SEQ ID NO: 14572 - RNA, 19 nt, Artificial Sequence
  Synthetic Oligonucleotide
agagaagaugggcuacaag

SEQ ID NO: 14573 - RNA, 19 nt, Artificial Sequence
  Synthetic Oligonucleotide
auagacccaucuaucagcu

SEQ ID NO: 14574 - RNA, 19 nt, Artificial Sequence
  Synthetic Oligonucleotide
uggcucugagugggugcca

SEQ ID NO: 14575 - RNA, 19 nt, Artificial Sequence
  Synthetic Oligonucleotide
gccguuuccaagaucugac

SEQ ID NO: 14576 - RNA, 19 nt, Artificial Sequence
  Synthetic Oligonucleotide
ggggugugcggaaaggcac

SEQ ID NO: 14577 - RNA, 19 nt, Artificial Sequence
  Synthetic Oligonucleotide
ucaauugaagaaguggcgg

SEQ ID NO: 14578 - RNA, 19 nt, Artificial Sequence
  Synthetic Oligonucleotide
ccugggccaccuccucaau

SEQ ID NO: 14579 - RNA, 19 nt, Artificial Sequence
  Synthetic Oligonucleotide
accuccucaauugaagaag

SEQ ID NO: 14580 - RNA, 19 nt, Artificial Sequence
  Synthetic Oligonucleotide
cuguuaaacauggcuugaa

SEQ ID NO: 14581 - RNA, 19 nt, Artificial Sequence
  Synthetic Oligonucleotide
uggccguuuccaagaucug

SEQ ID NO: 14582 - RNA, 19 nt, Artificial Sequence
  Synthetic Oligonucleotide
uccucaauugaagaagugg

SEQ ID NO: 14583 - RNA, 19 nt, Artificial Sequence
  Synthetic Oligonucleotide
uauauaugacuauuacagg

SEQ ID NO: 14584 - RNA, 19 nt, Artificial Sequence
  Synthetic Oligonucleotide
ggcacuucguuggcugcaa

SEQ ID NO: 14585 - RNA, 19 nt, Artificial Sequence
  Synthetic Oligonucleotide
uuccugggccaccuccuca

SEQ ID NO: 14586 - RNA, 19 nt, Artificial Sequence
  Synthetic Oligonucleotide
agcuguauccaaggaugcu

SEQ ID NO: 14587 - RNA, 19 nt, Artificial Sequence
  Synthetic Oligonucleotide
uaaacauggcuugaauggg

SEQ ID NO: 14588 - RNA, 19 nt, Artificial Sequence
  Synthetic Oligonucleotide
acacugugcagagggugac

SEQ ID NO: 14589 - RNA, 19 nt, Artificial Sequence
  Synthetic Oligonucleotide
gaggaaaaauccuuuggcc

SEQ ID NO: 14590 - RNA, 19 nt, Artificial Sequence
  Synthetic Oligonucleotide
gagagaauuggaaugggug

SEQ ID NO: 14591 - RNA, 19 nt, Artificial Sequence
  Synthetic Oligonucleotide
ugaagaaguggcggaagcu

SEQ ID NO: 14592 - RNA, 19 nt, Artificial Sequence
  Synthetic Oligonucleotide
auuccccacuucaauacaa

SEQ ID NO: 14593 - RNA, 19 nt, Artificial Sequence
  Synthetic Oligonucleotide
auacuaaaggaagaauucc

SEQ ID NO: 14594 - RNA, 19 nt, Artificial Sequence
  Synthetic Oligonucleotide
uguggaagggaagguggaa

SEQ ID NO: 14595 - RNA, 19 nt, Artificial Sequence
  Synthetic Oligonucleotide
uaugacuauuacaggucug

SEQ ID NO: 14596 - RNA, 19 nt, Artificial Sequence
  Synthetic Oligonucleotide
ugccacugugagagccugu

SEQ ID NO: 14597 - RNA, 19 nt, Artificial Sequence
  Synthetic Oligonucleotide
auuggaauggguggcggua

SEQ ID NO: 14598 - RNA, 19 nt, Artificial Sequence
  Synthetic Oligonucleotide
ccucaauugaagaaguggc

SEQ ID NO: 14599 - RNA, 19 nt, Artificial Sequence
  Synthetic Oligonucleotide
caacucgauggggugccag

SEQ ID NO: 14600 - RNA, 19 nt, Artificial Sequence
  Synthetic Oligonucleotide
caccuccucaauugaagaa

SEQ ID NO: 14601 - RNA, 19 nt, Artificial Sequence
  Synthetic Oligonucleotide
agaauuggaauggguggcg

SEQ ID NO: 14602 - RNA, 19 nt, Artificial Sequence
  Synthetic Oligonucleotide
aggaaaaauccuuuggccg

SEQ ID NO: 14603 - RNA, 19 nt, Artificial Sequence
  Synthetic Oligonucleotide
ggaagggaagguggaaguc

SEQ ID NO: 14604 - RNA, 19 nt, Artificial Sequence
  Synthetic Oligonucleotide
aucagcugggaagauauca

SEQ ID NO: 14605 - RNA, 19 nt, Artificial Sequence
  Synthetic Oligonucleotide
cuccucaauugaagaagug

SEQ ID NO: 14606 - RNA, 19 nt, Artificial Sequence
  Synthetic Oligonucleotide
cgacuucuguuuuaggaca

SEQ ID NO: 14607 - RNA, 19 nt, Artificial Sequence
  Synthetic Oligonucleotide
agcacuggagagaauugga

SEQ ID NO: 14608 - RNA, 19 nt, Artificial Sequence
  Synthetic Oligonucleotide
accaaucguuuggggcuua

SEQ ID NO: 14609 - RNA, 19 nt, Artificial Sequence
  Synthetic Oligonucleotide
gggccaccuccucaauuga

SEQ ID NO: 14610 - RNA, 19 nt, Artificial Sequence
  Synthetic Oligonucleotide
gcuguuaaacauggcuuga

SEQ ID NO: 14611 - RNA, 19 nt, Artificial Sequence
  Synthetic Oligonucleotide
acugauguucugaaagcuc

SEQ ID NO: 14612 - RNA, 19 nt, Artificial Sequence
  Synthetic Oligonucleotide
gugcguaacagauucaaac

SEQ ID NO: 14613 - RNA, 19 nt, Artificial Sequence
  Synthetic Oligonucleotide
gauucaaacugccgccaca

SEQ ID NO: 14614 - RNA, 19 nt, Artificial Sequence
  Synthetic Oligonucleotide
aauuggaauggguggcggu

SEQ ID NO: 14615 - RNA, 19 nt, Artificial Sequence
  Synthetic Oligonucleotide
ugaggaaaaauccuuuggc

SEQ ID NO: 14616 - RNA, 19 nt, Artificial Sequence
  Synthetic Oligonucleotide
cuggcaggcuaaagugcug

SEQ ID NO: 14617 - RNA, 19 nt, Artificial Sequence
  Synthetic Oligonucleotide
gaugaugccagggaggcug

SEQ ID NO: 14618 - RNA, 19 nt, Artificial Sequence
  Synthetic Oligonucleotide
cuugccacugugagagccu

SEQ ID NO: 14619 - RNA, 19 nt, Artificial Sequence
  Synthetic Oligonucleotide
gcauuuugagaggugauga

SEQ ID NO: 14620 - RNA, 19 nt, Artificial Sequence
  Synthetic Oligonucleotide
aguuccugggccaccuccu

SEQ ID NO: 14621 - RNA, 19 nt, Artificial Sequence
  Synthetic Oligonucleotide
auauaugacuauuacaggu

SEQ ID NO: 14622 - RNA, 19 nt, Artificial Sequence
  Synthetic Oligonucleotide
gacaguggacuugcugcau

SEQ ID NO: 14623 - RNA, 19 nt, Artificial Sequence
  Synthetic Oligonucleotide
uguuuagacaacgucaucc

SEQ ID NO: 14624 - RNA, 19 nt, Artificial Sequence
  Synthetic Oligonucleotide
uguucugccagaaauugug

SEQ ID NO: 14625 - RNA, 19 nt, Artificial Sequence
  Synthetic Oligonucleotide
aacucgauggggugccagc

SEQ ID NO: 14626 - RNA, 19 nt, Artificial Sequence
  Synthetic Oligonucleotide
gagaagucaccaagaagcu

SEQ ID NO: 14627 - RNA, 19 nt, Artificial Sequence
  Synthetic Oligonucleotide
ggugugcggaaaggcacug

SEQ ID NO: 14628 - RNA, 19 nt, Artificial Sequence
  Synthetic Oligonucleotide
ggaggcuguuaaacauggc

SEQ ID NO: 14629 - RNA, 19 nt, Artificial Sequence
  Synthetic Oligonucleotide
uuguggaggcuguggaagg

SEQ ID NO: 14630 - RNA, 19 nt, Artificial Sequence
  Synthetic Oligonucleotide
cuuggugucgaaucauggg

SEQ ID NO: 14631 - RNA, 19 nt, Artificial Sequence
  Synthetic Oligonucleotide
auucaaacugccgccacaa

SEQ ID NO: 14632 - RNA, 19 nt, Artificial Sequence
  Synthetic Oligonucleotide
gugaugaugccagggaggc

SEQ ID NO: 14633 - RNA, 19 nt, Artificial Sequence
  Synthetic Oligonucleotide
auaugacuauuacaggucu

SEQ ID NO: 14634 - RNA, 19 nt, Artificial Sequence
  Synthetic Oligonucleotide
ucgacaacucgauggggug

SEQ ID NO: 14635 - RNA, 19 nt, Artificial Sequence
  Synthetic Oligonucleotide
uuggugaggaaaaauccuu

SEQ ID NO: 14636 - RNA, 19 nt, Artificial Sequence
  Synthetic Oligonucleotide
cuaaaggaagaauuccggu

SEQ ID NO: 14637 - RNA, 19 nt, Artificial Sequence
  Synthetic Oligonucleotide
gcguaacagauucaaacug

SEQ ID NO: 14638 - RNA, 19 nt, Artificial Sequence
  Synthetic Oligonucleotide
gcuugccacugugagagcc

SEQ ID NO: 14639 - RNA, 19 nt, Artificial Sequence
  Synthetic Oligonucleotide
ccugggaacgggcaugaug

SEQ ID NO: 14640 - RNA, 19 nt, Artificial Sequence
  Synthetic Oligonucleotide
ucugccagaaauuguggag

SEQ ID NO: 14641 - RNA, 19 nt, Artificial Sequence
  Synthetic Oligonucleotide
uauaugacuauuacagguc

SEQ ID NO: 14642 - RNA, 19 nt, Artificial Sequence
  Synthetic Oligonucleotide
gaacgggcaugauguugag

SEQ ID NO: 14643 - RNA, 19 nt, Artificial Sequence
  Synthetic Oligonucleotide
gaggcuguuaaacauggcu

SEQ ID NO: 14644 - RNA, 19 nt, Artificial Sequence
  Synthetic Oligonucleotide
ggcacugauguucugaaag

SEQ ID NO: 14645 - RNA, 19 nt, Artificial Sequence
  Synthetic Oligonucleotide
augggaucuuggugucgaa

SEQ ID NO: 14646 - RNA, 19 nt, Artificial Sequence
  Synthetic Oligonucleotide
agaccaaucguuuggggcu

SEQ ID NO: 14647 - RNA, 19 nt, Artificial Sequence
  Synthetic Oligonucleotide
uagacaacgucauccccug

SEQ ID NO: 14648 - RNA, 19 nt, Artificial Sequence
  Synthetic Oligonucleotide
acugugcagagggugacca

SEQ ID NO: 14649 - RNA, 19 nt, Artificial Sequence
  Synthetic Oligonucleotide
acucgauggggugccagcc

SEQ ID NO: 14650 - RNA, 19 nt, Artificial Sequence
  Synthetic Oligonucleotide
uuaccugggcaaccgucug

SEQ ID NO: 14651 - RNA, 19 nt, Artificial Sequence
  Synthetic Oligonucleotide
uggaagcuguauccaagga

SEQ ID NO: 14652 - RNA, 19 nt, Artificial Sequence
  Synthetic Oligonucleotide
uggugucgaaucauggggc

SEQ ID NO: 14653 - RNA, 19 nt, Artificial Sequence
  Synthetic Oligonucleotide
augacuauuacaggucugg

SEQ ID NO: 14654 - RNA, 19 nt, Artificial Sequence
  Synthetic Oligonucleotide
uaccugggcaaccgucugg

SEQ ID NO: 14655 - RNA, 19 nt, Artificial Sequence
  Synthetic Oligonucleotide
gugucgaaucauggggcuc

SEQ ID NO: 14656 - RNA, 19 nt, Artificial Sequence
  Synthetic Oligonucleotide
ggccaccuccucaauugaa

SEQ ID NO: 14657 - RNA, 19 nt, Artificial Sequence
  Synthetic Oligonucleotide
gaggcuguggaagggaagg

SEQ ID NO: 14658 - RNA, 19 nt, Artificial Sequence
  Synthetic Oligonucleotide
guuuuaggacagaggguca

SEQ ID NO: 14659 - RNA, 19 nt, Artificial Sequence
  Synthetic Oligonucleotide
ggaaaaauccuuuggccgu

SEQ ID NO: 14660 - RNA, 19 nt, Artificial Sequence
  Synthetic Oligonucleotide
cugauguucugaaagcucu

SEQ ID NO: 14661 - RNA, 19 nt, Artificial Sequence
  Synthetic Oligonucleotide
gacuucuguuuuaggacag

SEQ ID NO: 14662 - RNA, 19 nt, Artificial Sequence
  Synthetic Oligonucleotide
aagggaagguggaagucuu

SEQ ID NO: 14663 - RNA, 19 nt, Artificial Sequence
  Synthetic Oligonucleotide
uuucuccugaggaaaauuu

SEQ ID NO: 14664 - RNA, 19 nt, Artificial Sequence
  Synthetic Oligonucleotide
caagaagcuagugcggcag

SEQ ID NO: 14665 - RNA, 19 nt, Artificial Sequence
  Synthetic Oligonucleotide
gcuguggaagggaaggugg

SEQ ID NO: 14666 - RNA, 19 nt, Artificial Sequence
  Synthetic Oligonucleotide
cugaggcacuucguuggcu

SEQ ID NO: 14667 - RNA, 19 nt, Artificial Sequence
  Synthetic Oligonucleotide
ugugcguaacagauucaaa

SEQ ID NO: 14668 - RNA, 19 nt, Artificial Sequence
  Synthetic Oligonucleotide
uccuuuggccguuuccaag

SEQ ID NO: 14669 - RNA, 19 nt, Artificial Sequence
  Synthetic Oligonucleotide
ugucgaaucauggggcucg

SEQ ID NO: 14670 - RNA, 19 nt, Artificial Sequence
  Synthetic Oligonucleotide
uuuggccguuuccaagauc

SEQ ID NO: 14671 - RNA, 19 nt, Artificial Sequence
  Synthetic Oligonucleotide
aacgucauccccuggcagg

SEQ ID NO: 14672 - RNA, 19 nt, Artificial Sequence
  Synthetic Oligonucleotide
uggugaggaaaaauccuuu

SEQ ID NO: 14673 - RNA, 19 nt, Artificial Sequence
  Synthetic Oligonucleotide
ggugaugaugccagggagg

SEQ ID NO: 14674 - RNA, 19 nt, Artificial Sequence
  Synthetic Oligonucleotide
acuaaaggaagaauuccgg

SEQ ID NO: 14675 - RNA, 19 nt, Artificial Sequence
  Synthetic Oligonucleotide
acuucuguuuuaggacaga

SEQ ID NO: 14676 - RNA, 19 nt, Artificial Sequence
  Synthetic Oligonucleotide
ccuuuggccguuuccaaga

SEQ ID NO: 14677 - RNA, 19 nt, Artificial Sequence
  Synthetic Oligonucleotide
ccaccuccucaauugaaga

SEQ ID NO: 14678 - RNA, 19 nt, Artificial Sequence
  Synthetic Oligonucleotide
auccuuuggccguuuccaa

SEQ ID NO: 14679 - RNA, 19 nt, Artificial Sequence
  Synthetic Oligonucleotide
ggugucgaaucauggggcu

SEQ ID NO: 14680 - RNA, 19 nt, Artificial Sequence
  Synthetic Oligonucleotide
ggaggcuguggaagggaag

SEQ ID NO: 14681 - RNA, 19 nt, Artificial Sequence
  Synthetic Oligonucleotide
auuguggaggcuguggaag

SEQ ID NO: 14682 - RNA, 19 nt, Artificial Sequence
  Synthetic Oligonucleotide
ccaaucguuuggggcuuag

SEQ ID NO: 14683 - RNA, 19 nt, Artificial Sequence
  Synthetic Oligonucleotide
gccagaaauuguggaggcu

SEQ ID NO: 14684 - RNA, 19 nt, Artificial Sequence
  Synthetic Oligonucleotide
accugggcaaccgucugga

SEQ ID NO: 14685 - RNA, 19 nt, Artificial Sequence
  Synthetic Oligonucleotide
cggaagcugguccugaggc

SEQ ID NO: 14686 - RNA, 19 nt, Artificial Sequence
  Synthetic Oligonucleotide
aaacauggcuugaauggga

SEQ ID NO: 14687 - RNA, 19 nt, Artificial Sequence
  Synthetic Oligonucleotide
gaggcacuucguuggcugc

SEQ ID NO: 14688 - RNA, 19 nt, Artificial Sequence
  Synthetic Oligonucleotide
cugugagagccugucaguc

SEQ ID NO: 14689 - RNA, 19 nt, Artificial Sequence
  Synthetic Oligonucleotide
ugaugccagggaggcuguu

SEQ ID NO: 14690 - RNA, 19 nt, Artificial Sequence
  Synthetic Oligonucleotide
cauuggugaggaaaaaucc

SEQ ID NO: 14691 - RNA, 19 nt, Artificial Sequence
  Synthetic Oligonucleotide
gccacugugagagccuguc

SEQ ID NO: 14692 - RNA, 19 nt, Artificial Sequence
  Synthetic Oligonucleotide
uggacggcgagcuugccac

SEQ ID NO: 14693 - RNA, 19 nt, Artificial Sequence
  Synthetic Oligonucleotide
ggaagcugguccugaggca

SEQ ID NO: 14694 - RNA, 19 nt, Artificial Sequence
  Synthetic Oligonucleotide
ucccugggaacgggcauga

SEQ ID NO: 14695 - RNA, 19 nt, Artificial Sequence
  Synthetic Oligonucleotide
aaugggaucuuggugucga

SEQ ID NO: 14696 - RNA, 19 nt, Artificial Sequence
  Synthetic Oligonucleotide
gaguuccugggccaccucc

SEQ ID NO: 14697 - RNA, 19 nt, Artificial Sequence
  Synthetic Oligonucleotide
gaaaaauccuuuggccguu

SEQ ID NO: 14698 - RNA, 19 nt, Artificial Sequence
  Synthetic Oligonucleotide
gaagggaagguggaagucu

SEQ ID NO: 14699 - RNA, 19 nt, Artificial Sequence
  Synthetic Oligonucleotide
uugaguuccugggccaccu

SEQ ID NO: 14700 - RNA, 19 nt, Artificial Sequence
  Synthetic Oligonucleotide
caauugaagaaguggcgga

SEQ ID NO: 14701 - RNA, 19 nt, Artificial Sequence
  Synthetic Oligonucleotide
caaucguuuggggcuuagc

SEQ ID NO: 14702 - RNA, 19 nt, Artificial Sequence
  Synthetic Oligonucleotide
cuuuggccguuuccaagau

SEQ ID NO: 14703 - RNA, 19 nt, Artificial Sequence
  Synthetic Oligonucleotide
aaggaagaauuccgguugg

SEQ ID NO: 14704 - RNA, 19 nt, Artificial Sequence
  Synthetic Oligonucleotide
ccagggaggcuguuaaaca

SEQ ID NO: 14705 - RNA, 19 nt, Artificial Sequence
  Synthetic Oligonucleotide
guguuuguggggagaccaa

SEQ ID NO: 14706 - RNA, 19 nt, Artificial Sequence
  Synthetic Oligonucleotide
ccagaaauuguggaggcug

SEQ ID NO: 14707 - RNA, 19 nt, Artificial Sequence
  Synthetic Oligonucleotide
ggcaggcuaaagugcugua

SEQ ID NO: 14708 - RNA, 19 nt, Artificial Sequence
  Synthetic Oligonucleotide
cagagaagaugggcuacaa

SEQ ID NO: 14709 - RNA, 19 nt, Artificial Sequence
  Synthetic Oligonucleotide
agaagucaccaagaagcua

SEQ ID NO: 14710 - RNA, 19 nt, Artificial Sequence
  Synthetic Oligonucleotide
auguggacggcgagcuugc

SEQ ID NO: 14711 - RNA, 19 nt, Artificial Sequence
  Synthetic Oligonucleotide
ccacugugagagccuguca

SEQ ID NO: 14712 - RNA, 19 nt, Artificial Sequence
  Synthetic Oligonucleotide
acuuuucaauggguguccu

SEQ ID NO: 14713 - RNA, 19 nt, Artificial Sequence
  Synthetic Oligonucleotide
gcuguauccaaggaugcuc

SEQ ID NO: 14714 - RNA, 19 nt, Artificial Sequence
  Synthetic Oligonucleotide
auguugaguuccugggcca

SEQ ID NO: 14715 - RNA, 19 nt, Artificial Sequence
  Synthetic Oligonucleotide
aaaaauccuuuggccguuu

SEQ ID NO: 14716 - RNA, 19 nt, Artificial Sequence
  Synthetic Oligonucleotide
ccuggcaggcuaaagugcu

SEQ ID NO: 14717 - RNA, 19 nt, Artificial Sequence
  Synthetic Oligonucleotide
aaaauccuuuggccguuuc

SEQ ID NO: 14718 - RNA, 19 nt, Artificial Sequence
  Synthetic Oligonucleotide
gaaauuguggaggcugugg

SEQ ID NO: 14719 - RNA, 19 nt, Artificial Sequence
  Synthetic Oligonucleotide
cuggagagaauuggaaugg

SEQ ID NO: 14720 - RNA, 19 nt, Artificial Sequence
  Synthetic Oligonucleotide
augauguugaguuccuggg

SEQ ID NO: 14721 - RNA, 19 nt, Artificial Sequence
  Synthetic Oligonucleotide
gauguucugccagaaauug

SEQ ID NO: 14722 - RNA, 19 nt, Artificial Sequence
  Synthetic Oligonucleotide
agaagcuagugcggcaggc

SEQ ID NO: 14723 - RNA, 19 nt, Artificial Sequence
  Synthetic Oligonucleotide
ucgaaucauggggcucgac

SEQ ID NO: 14724 - RNA, 19 nt, Artificial Sequence
  Synthetic Oligonucleotide
ugccagggaggcuguuaaa

SEQ ID NO: 14725 - RNA, 19 nt, Artificial Sequence
  Synthetic Oligonucleotide
cacuggagagaauuggaau

SEQ ID NO: 14726 - RNA, 19 nt, Artificial Sequence
  Synthetic Oligonucleotide
gcagagaagaugggcuaca

SEQ ID NO: 14727 - RNA, 19 nt, Artificial Sequence
  Synthetic Oligonucleotide
ggagaccaaucguuugggg

SEQ ID NO: 14728 - RNA, 19 nt, Artificial Sequence
  Synthetic Oligonucleotide
aauuguggaggcuguggaa

SEQ ID NO: 14729 - RNA, 19 nt, Artificial Sequence
  Synthetic Oligonucleotide
cgaaucauggggcucgaca

SEQ ID NO: 14730 - RNA, 19 nt, Artificial Sequence
  Synthetic Oligonucleotide
guccugaggcacuucguug

SEQ ID NO: 14731 - RNA, 19 nt, Artificial Sequence
  Synthetic Oligonucleotide
agucccugggaacgggcau

SEQ ID NO: 14732 - RNA, 19 nt, Artificial Sequence
  Synthetic Oligonucleotide
acugugagagccugucagu

SEQ ID NO: 14733 - RNA, 19 nt, Artificial Sequence
  Synthetic Oligonucleotide
uggagagaauuggaauggg

SEQ ID NO: 14734 - RNA, 19 nt, Artificial Sequence
  Synthetic Oligonucleotide
auggcucugagugggugcc

SEQ ID NO: 14735 - RNA, 19 nt, Artificial Sequence
  Synthetic Oligonucleotide
gaagucaccaagaagcuag

SEQ ID NO: 14736 - RNA, 19 nt, Artificial Sequence
  Synthetic Oligonucleotide
uaaaggaagaauuccgguu

SEQ ID NO: 14737 - RNA, 19 nt, Artificial Sequence
  Synthetic Oligonucleotide
uuggccguuuccaagaucu

SEQ ID NO: 14738 - RNA, 19 nt, Artificial Sequence
  Synthetic Oligonucleotide
aauccuuuggccguuucca

SEQ ID NO: 14739 - RNA, 19 nt, Artificial Sequence
  Synthetic Oligonucleotide
cggcaggcagagaagaugg

SEQ ID NO: 14740 - RNA, 19 nt, Artificial Sequence
  Synthetic Oligonucleotide
ugugagagccugucagucc

SEQ ID NO: 14741 - RNA, 19 nt, Artificial Sequence
  Synthetic Oligonucleotide
guucugccagaaauugugg

SEQ ID NO: 14742 - RNA, 19 nt, Artificial Sequence
  Synthetic Oligonucleotide
aagaagcuagugcggcagg

SEQ ID NO: 14743 - RNA, 19 nt, Artificial Sequence
  Synthetic Oligonucleotide
agauucaaacugccgccac

SEQ ID NO: 14744 - RNA, 19 nt, Artificial Sequence
  Synthetic Oligonucleotide
uguuuguggggagaccaau

SEQ ID NO: 14745 - RNA, 19 nt, Artificial Sequence
  Synthetic Oligonucleotide
uguuuuaggacagaggguc

SEQ ID NO: 14746 - RNA, 19 nt, Artificial Sequence
  Synthetic Oligonucleotide
agggaagguggaagucuuc

SEQ ID NO: 14747 - RNA, 19 nt, Artificial Sequence
  Synthetic Oligonucleotide
auuggugaggaaaaauccu

SEQ ID NO: 14748 - RNA, 19 nt, Artificial Sequence
  Synthetic Oligonucleotide
agacaacgucauccccugg

SEQ ID NO: 14749 - RNA, 19 nt, Artificial Sequence
  Synthetic Oligonucleotide
guuuagacaacgucauccc

SEQ ID NO: 14750 - RNA, 19 nt, Artificial Sequence
  Synthetic Oligonucleotide
ggugaggaaaaauccuuug

SEQ ID NO: 14751 - RNA, 19 nt, Artificial Sequence
  Synthetic Oligonucleotide
ggcaggcagagaagauggg

SEQ ID NO: 14752 - RNA, 19 nt, Artificial Sequence
  Synthetic Oligonucleotide
gccaccuccucaauugaag

SEQ ID NO: 14753 - RNA, 19 nt, Artificial Sequence
  Synthetic Oligonucleotide
caugauguugaguuccugg

SEQ ID NO: 14754 - RNA, 19 nt, Artificial Sequence
  Synthetic Oligonucleotide
ggagagaauuggaaugggu

SEQ ID NO: 14755 - RNA, 19 nt, Artificial Sequence
  Synthetic Oligonucleotide
ccuccucaauugaagaagu

SEQ ID NO: 14756 - RNA, 19 nt, Artificial Sequence
  Synthetic Oligonucleotide
acuggagagaauuggaaug

SEQ ID NO: 14757 - RNA, 19 nt, Artificial Sequence
  Synthetic Oligonucleotide
uccccuggcaggcuaaagu

SEQ ID NO: 14758 - RNA, 19 nt, Artificial Sequence
  Synthetic Oligonucleotide
uggaggcuguggaagggaa

SEQ ID NO: 14759 - RNA, 19 nt, Artificial Sequence
  Synthetic Oligonucleotide
cauggcucugagugggugc

SEQ ID NO: 14760 - RNA, 19 nt, Artificial Sequence
  Synthetic Oligonucleotide
aagucaccaagaagcuagu

SEQ ID NO: 14761 - RNA, 19 nt, Artificial Sequence
  Synthetic Oligonucleotide
uugaagaaguggcggaagc

SEQ ID NO: 14762 - RNA, 19 nt, Artificial Sequence
  Synthetic Oligonucleotide
ugaguuccugggccaccuc

SEQ ID NO: 14763 - RNA, 19 nt, Artificial Sequence
  Synthetic Oligonucleotide
uccugaggcacuucguugg

SEQ ID NO: 14764 - RNA, 19 nt, Artificial Sequence
  Synthetic Oligonucleotide
guuccugggccaccuccuc

SEQ ID NO: 14765 - RNA, 19 nt, Artificial Sequence
  Synthetic Oligonucleotide
uguggaggcuguggaaggg

SEQ ID NO: 14766 - RNA, 19 nt, Artificial Sequence
  Synthetic Oligonucleotide
aucuuggugucgaaucaug

SEQ ID NO: 14767 - RNA, 19 nt, Artificial Sequence
  Synthetic Oligonucleotide
guggaggcuguggaaggga

SEQ ID NO: 14768 - RNA, 19 nt, Artificial Sequence
  Synthetic Oligonucleotide
ugggaucuuggugucgaau

SEQ ID NO: 14769 - RNA, 19 nt, Artificial Sequence
  Synthetic Oligonucleotide
gucccugggaacgggcaug

SEQ ID NO: 14770 - RNA, 19 nt, Artificial Sequence
  Synthetic Oligonucleotide
uuuugagaggugaugaugc

SEQ ID NO: 14771 - RNA, 19 nt, Artificial Sequence
  Synthetic Oligonucleotide
cauggcuugaaugggaucu

SEQ ID NO: 14772 - RNA, 19 nt, Artificial Sequence
  Synthetic Oligonucleotide
ccauggcucugagugggug

SEQ ID NO: 14773 - RNA, 19 nt, Artificial Sequence
  Synthetic Oligonucleotide
gagaggugaugaugccagg

SEQ ID NO: 14774 - RNA, 19 nt, Artificial Sequence
  Synthetic Oligonucleotide
gcgagcuugccacugugag

SEQ ID NO: 14775 - RNA, 19 nt, Artificial Sequence
  Synthetic Oligonucleotide
uguugaguuccugggccac

SEQ ID NO: 14776 - RNA, 19 nt, Artificial Sequence
  Synthetic Oligonucleotide
cggcgagcuugccacugug

SEQ ID NO: 14777 - RNA, 19 nt, Artificial Sequence
  Synthetic Oligonucleotide
cauguggacggcgagcuug

SEQ ID NO: 14778 - RNA, 19 nt, Artificial Sequence
  Synthetic Oligonucleotide
aaauuguggaggcugugga

SEQ ID NO: 14779 - RNA, 19 nt, Artificial Sequence
  Synthetic Oligonucleotide
aauugaagaaguggcggaa

SEQ ID NO: 14780 - RNA, 19 nt, Artificial Sequence
  Synthetic Oligonucleotide
gacaacucgauggggugcc

SEQ ID NO: 14781 - RNA, 19 nt, Artificial Sequence
  Synthetic Oligonucleotide
aggaagaauuccgguuggc

SEQ ID NO: 14782 - RNA, 19 nt, Artificial Sequence
  Synthetic Oligonucleotide
aggcagagaagaugggcua

SEQ ID NO: 14783 - RNA, 19 nt, Artificial Sequence
  Synthetic Oligonucleotide
gaccaaucguuuggggcuu

SEQ ID NO: 14784 - RNA, 19 nt, Artificial Sequence
  Synthetic Oligonucleotide
gugaggaaaaauccuuugg

SEQ ID NO: 14785 - RNA, 19 nt, Artificial Sequence
  Synthetic Oligonucleotide
caacgucauccccuggcag

SEQ ID NO: 14786 - RNA, 19 nt, Artificial Sequence
  Synthetic Oligonucleotide
cacugugagagccugucag

SEQ ID NO: 14787 - RNA, 19 nt, Artificial Sequence
  Synthetic Oligonucleotide
acgucauccccuggcaggc

SEQ ID NO: 14788 - RNA, 19 nt, Artificial Sequence
  Synthetic Oligonucleotide
gacaacgucauccccuggc

SEQ ID NO: 14789 - RNA, 19 nt, Artificial Sequence
  Synthetic Oligonucleotide
gaaucauggggcucgacaa

SEQ ID NO: 14790 - RNA, 19 nt, Artificial Sequence
  Synthetic Oligonucleotide
aaauccuuuggccguuucc

SEQ ID NO: 14791 - RNA, 19 nt, Artificial Sequence
  Synthetic Oligonucleotide
ccccuggcaggcuaaagug

SEQ ID NO: 14792 - RNA, 19 nt, Artificial Sequence
  Synthetic Oligonucleotide
ucuuggugucgaaucaugg

SEQ ID NO: 14793 - RNA, 19 nt, Artificial Sequence
  Synthetic Oligonucleotide
ucauguggacggcgagcuu

SEQ ID NO: 14794 - RNA, 19 nt, Artificial Sequence
  Synthetic Oligonucleotide
aagaauuccgguuggccau

SEQ ID NO: 14795 - RNA, 19 nt, Artificial Sequence
  Synthetic Oligonucleotide
ucaccaagaagcuagugcg

SEQ ID NO: 14796 - RNA, 19 nt, Artificial Sequence
  Synthetic Oligonucleotide
ggaagguggaagucuuccu

SEQ ID NO: 14797 - RNA, 19 nt, Artificial Sequence
  Synthetic Oligonucleotide
ugauguugaguuccugggc

SEQ ID NO: 14798 - RNA, 19 nt, Artificial Sequence
  Synthetic Oligonucleotide
accuuaccugggcaaccgu

SEQ ID NO: 14799 - RNA, 19 nt, Artificial Sequence
  Synthetic Oligonucleotide
cgacaacucgauggggugc

SEQ ID NO: 14800 - RNA, 19 nt, Artificial Sequence
  Synthetic Oligonucleotide
ugagaggugaugaugccag

SEQ ID NO: 14801 - RNA, 19 nt, Artificial Sequence
  Synthetic Oligonucleotide
cugggcaaccgucuggaug

SEQ ID NO: 14802 - RNA, 19 nt, Artificial Sequence
  Synthetic Oligonucleotide
cccuggcaggcuaaagugc

SEQ ID NO: 14803 - RNA, 19 nt, Artificial Sequence
  Synthetic Oligonucleotide
ggcgagcuugccacuguga

SEQ ID NO: 14804 - RNA, 19 nt, Artificial Sequence
  Synthetic Oligonucleotide
gaagaaguggcggaagcug

SEQ ID NO: 14805 - RNA, 19 nt, Artificial Sequence
  Synthetic Oligonucleotide
agcuagugcggcaggcaga

SEQ ID NO: 14806 - RNA, 19 nt, Artificial Sequence
  Synthetic Oligonucleotide
guuuguggggagaccaauc

SEQ ID NO: 14807 - RNA, 19 nt, Artificial Sequence
  Synthetic Oligonucleotide
agaauuccgguuggccaug

SEQ ID NO: 14808 - RNA, 19 nt, Artificial Sequence
  Synthetic Oligonucleotide
gcaugauguugaguuccug

SEQ ID NO: 14809 - RNA, 19 nt, Artificial Sequence
  Synthetic Oligonucleotide
gaggugaugaugccaggga

SEQ ID NO: 14810 - RNA, 19 nt, Artificial Sequence
  Synthetic Oligonucleotide
gaagcuagugcggcaggca

SEQ ID NO: 14811 - RNA, 19 nt, Artificial Sequence
  Synthetic Oligonucleotide
acaacucgauggggugcca

SEQ ID NO: 14812 - RNA, 19 nt, Artificial Sequence
  Synthetic Oligonucleotide
ggacggcgagcuugccacu

SEQ ID NO: 14813 - RNA, 19 nt, Artificial Sequence
  Synthetic Oligonucleotide
aaaggaagaauuccgguug

SEQ ID NO: 14814 - RNA, 19 nt, Artificial Sequence
  Synthetic Oligonucleotide
ggcucgacaacucgauggg

SEQ ID NO: 14815 - RNA, 19 nt, Artificial Sequence
  Synthetic Oligonucleotide
gcacuggagagaauuggaa

SEQ ID NO: 14816 - RNA, 19 nt, Artificial Sequence
  Synthetic Oligonucleotide
agaggugaugaugccaggg

SEQ ID NO: 14817 - RNA, 19 nt, Artificial Sequence
  Synthetic Oligonucleotide
uucugccagaaauugugga

SEQ ID NO: 14818 - RNA, 19 nt, Artificial Sequence
  Synthetic Oligonucleotide
auugaagaaguggcggaag

SEQ ID NO: 14819 - RNA, 19 nt, Artificial Sequence
  Synthetic Oligonucleotide
gggagaccaaucguuuggg

SEQ ID NO: 14820 - RNA, 19 nt, Artificial Sequence
  Synthetic Oligonucleotide
guggacggcgagcuugcca

SEQ ID NO: 14821 - RNA, 19 nt, Artificial Sequence
  Synthetic Oligonucleotide
cacaccuuaccugggcaac

SEQ ID NO: 14822 - RNA, 19 nt, Artificial Sequence
  Synthetic Oligonucleotide
gggaucuuggugucgaauc

SEQ ID NO: 14823 - RNA, 19 nt, Artificial Sequence
  Synthetic Oligonucleotide
caccaagaagcuagugcgg

SEQ ID NO: 14824 - RNA, 19 nt, Artificial Sequence
  Synthetic Oligonucleotide
guugaguuccugggccacc

SEQ ID NO: 14825 - RNA, 19 nt, Artificial Sequence
  Synthetic Oligonucleotide
ucagucccugggaacgggc

SEQ ID NO: 14826 - RNA, 19 nt, Artificial Sequence
  Synthetic Oligonucleotide
cucgacaacucgauggggu

SEQ ID NO: 14827 - RNA, 19 nt, Artificial Sequence
  Synthetic Oligonucleotide
ggaucuuggugucgaauca

SEQ ID NO: 14828 - RNA, 19 nt, Artificial Sequence
  Synthetic Oligonucleotide
aagcuagugcggcaggcag

SEQ ID NO: 14829 - RNA, 19 nt, Artificial Sequence
  Synthetic Oligonucleotide
gacggcgagcuugccacug

SEQ ID NO: 14830 - RNA, 19 nt, Artificial Sequence
  Synthetic Oligonucleotide
ccugaggcacuucguuggc

SEQ ID NO: 14831 - RNA, 19 nt, Artificial Sequence
  Synthetic Oligonucleotide
cgggcaugauguugaguuc

SEQ ID NO: 14832 - RNA, 19 nt, Artificial Sequence
  Synthetic Oligonucleotide
acggcgagcuugccacugu

SEQ ID NO: 14833 - RNA, 19 nt, Artificial Sequence
  Synthetic Oligonucleotide
gugagagccugucaguccc

SEQ ID NO: 14834 - RNA, 19 nt, Artificial Sequence
  Synthetic Oligonucleotide
ugucagucccugggaacgg

SEQ ID NO: 14835 - RNA, 19 nt, Artificial Sequence
  Synthetic Oligonucleotide
ggccguuuccaagaucuga

SEQ ID NO: 14836 - RNA, 19 nt, Artificial Sequence
  Synthetic Oligonucleotide
ggcagagaagaugggcuac

SEQ ID NO: 14837 - RNA, 19 nt, Artificial Sequence
  Synthetic Oligonucleotide
aacgggcaugauguugagu

SEQ ID NO: 14838 - RNA, 19 nt, Artificial Sequence
  Synthetic Oligonucleotide
cuuaccugggcaaccgucu

SEQ ID NO: 14839 - RNA, 19 nt, Artificial Sequence
  Synthetic Oligonucleotide
cagucccugggaacgggca

SEQ ID NO: 14840 - RNA, 19 nt, Artificial Sequence
  Synthetic Oligonucleotide
gaagcugguccugaggcac

SEQ ID NO: 14841 - RNA, 19 nt, Artificial Sequence
  Synthetic Oligonucleotide
gggaagguggaagucuucc

SEQ ID NO: 14842 - RNA, 19 nt, Artificial Sequence
  Synthetic Oligonucleotide
gucagucccugggaacggg

SEQ ID NO: 14843 - RNA, 19 nt, Artificial Sequence
  Synthetic Oligonucleotide
ugagagccugucagucccu

SEQ ID NO: 14844 - RNA, 19 nt, Artificial Sequence
  Synthetic Oligonucleotide
caccuuaccugggcaaccg

SEQ ID NO: 14845 - RNA, 19 nt, Artificial Sequence
  Synthetic Oligonucleotide
ucauggggcucgacaacuc

SEQ ID NO: 14846 - RNA, 19 nt, Artificial Sequence
  Synthetic Oligonucleotide
ccaugcagcgcauggcuca

SEQ ID NO: 14847 - RNA, 19 nt, Artificial Sequence
  Synthetic Oligonucleotide
ggggagaccaaucguuugg

SEQ ID NO: 14848 - RNA, 19 nt, Artificial Sequence
  Synthetic Oligonucleotide
ucauccccuggcaggcuaa

SEQ ID NO: 14849 - RNA, 19 nt, Artificial Sequence
  Synthetic Oligonucleotide
uuguggggagaccaaucgu

SEQ ID NO: 14850 - RNA, 19 nt, Artificial Sequence
  Synthetic Oligonucleotide
ccaagaagcuagugcggca

SEQ ID NO: 14851 - RNA, 19 nt, Artificial Sequence
  Synthetic Oligonucleotide
acaacgucauccccuggca

SEQ ID NO: 14852 - RNA, 19 nt, Artificial Sequence
  Synthetic Oligonucleotide
acgggcaugauguugaguu

SEQ ID NO: 14853 - RNA, 19 nt, Artificial Sequence
  Synthetic Oligonucleotide
uuugagaggugaugaugcc

SEQ ID NO: 14854 - RNA, 19 nt, Artificial Sequence
  Synthetic Oligonucleotide
auguucugaaagcucuggc

SEQ ID NO: 14855 - RNA, 19 nt, Artificial Sequence
  Synthetic Oligonucleotide
uguggacggcgagcuugcc

SEQ ID NO: 14856 - RNA, 19 nt, Artificial Sequence
  Synthetic Oligonucleotide
gccagggaggcuguuaaac

SEQ ID NO: 14857 - RNA, 19 nt, Artificial Sequence
  Synthetic Oligonucleotide
uuagacaacgucauccccu

SEQ ID NO: 14858 - RNA, 19 nt, Artificial Sequence
  Synthetic Oligonucleotide
ccugggcaaccgucuggau

SEQ ID NO: 14859 - RNA, 19 nt, Artificial Sequence
  Synthetic Oligonucleotide
cauccccuggcaggcuaaa

SEQ ID NO: 14860 - DNA, 37 bp, Artificial Sequence
  Synthetic Oligonucleotide
  misc_feature (1)..(27): n is a, c, g, t or u
nnnnnnnnnnnnnnnnnnnnnnnnnnnuagcuaucgt

---

We claim:

1. A nucleic acid comprising an oligonucleotide strand of 19-80 nucleotides in length, wherein said oligonucleotide strand is complementary to SEQ ID NO: 2116 along at least 19 consecutive nucleotides of said oligonucleotide strand length and reduces HAO1 target mRNA expression when said nucleic acid is introduced into a mammalian cell.

2. The nucleic acid of claim 1, wherein said oligonucleotide strand is 19-35 nucleotides in length.

3. A double stranded nucleic acid (dsNA) comprising first and second nucleic acid strands, wherein said first strand is 15-66 nucleotides in length and said second strand of said dsNA is 19-66 nucleotides in length, wherein said second strand is complementary to SEQ ID NO: 2116 along at least 19 consecutive nucleotides of said second strand length and reduces HAO1 target mRNA expression when said double stranded nucleic acid is introduced into a mammalian cell.

4. A double stranded nucleic acid (dsNA) comprising first and second nucleic acid strands and a duplex region of at least 25 base pairs, wherein said first strand is 25-65 nucleotides in length and said second strand of said dsNA is 26-66 nucleotides in length and comprises 1-5 single-stranded nucleotides at its 3' terminus, wherein said second strand is complementary to SEQ ID NO: 2116 along at least 19 consecutive nucleotides of said second strand length and reduces HAO1 target gene expression when said double stranded nucleic acid is introduced into a mammalian cell.

5. A double stranded nucleic acid (dsNA) comprising first and second nucleic acid strands and a duplex region of at least 25 base pairs, wherein said first strand is 25-65 nucleotides in length and said second strand of said dsNA is 26-66 nucleotides in length and comprises 1-5 single-stranded nucleotides at its 3' terminus, wherein the 3' terminus of said first strand and the 5' terminus of said second strand form a blunt end, and said second strand is complementary to SEQ ID NO: 2116 along at least 19 consecutive nucleotides of said second strand length and reduces HAO1 mRNA expression when said double stranded nucleic acid is introduced into a mammalian cell.

6. The dsNA of claim 3, wherein said first strand is 15-35 nucleotides in length.

7. The dsNA of claim 3, wherein said second strand is 19-35 nucleotides in length.

8. The dsNA of claim 3 comprising a duplex region selected from the group consisting of at least 25 base pairs; 19-21 base pairs and 21-25 base pairs.

9. The dsNA of claim 3, wherein said second strand comprises 1-5 single-stranded nucleotides at its 3' terminus.

10. The dsNA of claim 3, wherein said second strand comprises 5-35 single-stranded nucleotides at its 3' terminus.

11. The dsNA of claim 10, wherein said single-stranded nucleotides comprise modified nucleotides.

12. The dsNA of claim 10, wherein said single-stranded nucleotides comprise modified nucleotides selected from the group consisting of 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and 2'-O-(N-methlycarbamate).

13. The dsNA of claim 10, wherein said single-stranded nucleotides comprise ribonucleotides.

14. The dsNA of claim 10, wherein said single-stranded nucleotides comprise deoxyribonucleotides.

15. The dsNA of claim 3, wherein the 3' end of the first strand and the 5' end of the second strand are joined by a polynucleotide sequence comprising ribonucleotides, deoxyribonucleotides or both, optionally wherein the polynucleotide sequence comprises a tetraloop sequence.

16. The dsNA of claim 3, wherein said first strand is 25-35 nucleotides in length.

17. The dsNA of claim 3, wherein said second strand is 25-35 nucleotides in length.

18. The dsNA of claim 3, wherein starting from the first nucleotide (position 1) at the 3' terminus of the first oligonucleotide strand, position 1, 2 and/or 3 is substituted with a modified nucleotide.

19. The dsNA of claim 3, wherein the 3' terminus of said first strand and the 5' terminus of said second strand form a blunt end.

20. The dsNA of claim 3, wherein said first strand is 25 nucleotides in length and said second strand is 27 nucleotides in length.

21. The dsNA of claim 3, wherein said second strand comprises SEQ ID NO: 580.

22. The dsNA of claim 3, wherein said first strand comprises SEQ ID NO: 196.

23. The dsNA of claim 3 comprising SEQ ID NO: 580 and SEQ ID NO: 196.

24. The dsNA of claim 11, wherein said modified nucleotide residue of said 3' terminus of said first strand is selected from the group consisting of a deoxyribonucleotide, an acyclonucleotide and a fluorescent molecule.

25. The dsNA of claim 24, wherein position 1 of said 3' terminus of the first strand is a deoxyribonucleotide.

26. The dsNA of claim 10, wherein said nucleotides of said 5-35 single-stranded nucleotides of said 3' terminus of said second strand comprise a modified nucleotide.

27. The dsNA of claim 26, wherein said modified nucleotide of said 5-35 single-stranded nucleotides of said 3' terminus of said second strand is a 2'-O-methyl ribonucleotide.

28. The dsNA of claim 26, wherein all nucleotides of said 5-35 single-stranded nucleotides of said 3' terminus of said second strand are modified nucleotides.

29. The dsNA of claim 3, wherein said dsNA comprises a modified nucleotide.

30. The dsNA of claim 29, wherein said modified nucleotide residue is selected from the group consisting of 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and 2'-O-(N-methlycarbamate).

31. The dsNA of claim 9, wherein said 1-5 single-stranded nucleotides of said 3' terminus of said second strand are 1-3 nucleotides in length.

32. The dsNA of claim 9, wherein said 1-5 single-stranded nucleotides of said 3' terminus of said second strand are 1-2 nucleotides in length.

33. The dsNA of claim 9, wherein said 1-5 single-stranded nucleotides of said 3' terminus of said second strand is two nucleotides in length and comprises a 2'-O-methyl modified ribonucleotide.

34. The dsNA of claim 3, wherein said second strand comprises an AS-M58 modification pattern.

35. The dsNA of claim 3, wherein said first strand comprises a SM250 modification pattern.

36. The dsNA of claim 3, wherein the amount of said nucleic acid sufficient to reduce expression of the target gene is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

37. The nucleic acid of claim 1, wherein said nucleic acid reduces HAO1 target mRNA expression by an amount (expressed by %) selected from the group consisting of at least 10%, at least 50%, at least 80-90%, at least 95%, at least 98%, and at least 99% when said nucleic acid is introduced into a mammalian cell.

38. The dsNA of claim 3, wherein the first and second strands are joined by a chemical linker.

39. The double stranded nucleic acid of claim 3, wherein the 3' terminus of said first strand and the 5' terminus of said second strand are joined by a chemical linker.

40. The double stranded nucleic acid of claim 3, wherein a nucleotide of said second or first strand is substituted with a modified nucleotide that directs the orientation of Dicer cleavage.

41. The nucleic acid of claim 1 comprising a modified nucleotide selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid.

42. The nucleic acid of claim 1 comprising a phosphate backbone modification selected from the group consisting of a phosphonate, a phosphorothioate and a phosphotriester.

43. The nucleic acid of claim 1 comprising a modification selected from the group consisting of a morpholino nucleic acid and a peptide nucleic acid (PNA).

44. The nucleic acid of claim 1, wherein said nucleic acid is attached to a dynamic polyconjugate (DPC).

45. The nucleic acid of claim 1, wherein said nucleic acid is administered with a DPC.

46. The nucleic acid of claim 1, wherein said nucleic acid is attached to a moiety selected from the group consisting of a GalNAc moiety, a cholesterol and a cholesterol targeting ligand.

47. A dsNA comprising a first strand and a second strand, wherein the first strand and the second strand form a duplex region of 19-25 nucleotides in length, wherein the first strand comprises a 3' region that extends beyond the first strand-second strand duplex region and comprises a tetraloop, and the dsNA further comprises a discontinuity between the 3' terminus of the first strand and the 5' terminus of the second strand, and the first or second strand is complementary to SEQ ID NO: 2116 along at least 19 consecutive nucleotides of the first or second strand length and reduces HAO1 target mRNA expression when the dsNA is introduced into a mammalian cell.

48. A method for reducing expression of a target HAO1 gene in a mammalian cell comprising contacting a mammalian cell in vitro with a dsNA of claim 47 in an amount sufficient to reduce expression of a target HAO1 mRNA in said cell.

49. The method of claim 48, wherein target HAO1 mRNA expression is reduced by an amount (expressed by %) selected from the group consisting of at least 10%, at least 50% and at least 80-90%.

50. The method of claim 48, wherein HAO1 mRNA levels are reduced by an amount (expressed by %) of at least 90% at least 8 days after said cell is contacted with said dsNA.

51. The method of claim 48, wherein HAO1 mRNA levels are reduced by an amount (expressed by %) of at least 70% at least 10 days after said cell is contacted with said dsNA.

52. A method for reducing expression of a target HAO1 mRNA in a mammal comprising administering a dsNA of claim 47 to a mammal in an amount sufficient to reduce expression of a target HAO1 mRNA in the mammal.

53. The method of claim 52, wherein said dsNA is formulated in a lipid nanoparticle (LNP).

54. The method of claim 52, wherein said dsNA is administered at a dosage selected from the group consisting of 1 microgram to 5 milligrams per kilogram of said mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

55. The method of claim 52, wherein HAO1 mRNA levels are reduced in a tissue of said mammal by an amount (expressed by %) of at least 70% at least 3 days after said dsNA is administered to said mammal.

56. The method claim 55, wherein said tissue is liver tissue.

57. The method of claim 52, wherein said administering step comprises a mode selected from the group consisting of intravenous injection, intramuscular injection, intraperitoneal injection, infusion, subcutaneous injection, transdermal, aerosol, rectal, vaginal, topical, oral and inhaled delivery.

58. A method for treating or preventing a disease or disorder in a subject comprising administering to said subject an amount of a dsNA of claim 47 sufficient to treat or prevent said disease or disorder in said subject.

59. The method of claim 58, wherein said disease or disorder is primary hyperoxaluria 1 (PH1).

60. The method of claim 58, wherein said subject is human.

61. A formulation comprising the dsNA of claim 47, wherein said dsNA is present in an amount effective to reduce target HAO1 mRNA levels when said formulation is introduced into a mammalian cell in vitro by an amount (expressed by %) selected from the group consisting of at least 10%, at least 50% and at least 80-90%.

62. The formulation of claim 61, wherein said effective amount is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

63. A formulation comprising the dsNA of claim 47, wherein said dsNA is present in an amount effective to reduce target HAO1 mRNA levels when said formulation is introduced into a cell of a mammalian subject by an amount (expressed by %) selected from the group consisting of at least 10%, at least 50% and at least 80-90%.

64. The formulation of claim 63, wherein said effective amount is a dosage selected from the group consisting of 1 microgram to 5 milligrams per kilogram of said subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

65. An isolated mammalian cell containing the dsNA of claim 47.

66. A pharmaceutical composition comprising the dsNA of claim 47 and a pharmaceutically acceptable carrier.

67. A kit comprising the dsNA of claim 47 and instructions for its use.

68. A composition possessing HAO1 inhibitory activity consisting essentially of a dsNA of claim 47.

* * * * *